US012781238B2

(12) United States Patent
Jin et al.

(10) Patent No.: US 12,781,238 B2
(45) Date of Patent: Nov. 3, 2026

(54) IMMUNE REGULATORS INVOLVED IN DEFENSE AGAINST PLANT DISEASES CAUSED BY LIBERIBACTER SPECIES

(71) Applicant: The Regents of the University of California, Oakland, CA (US)

(72) Inventors: Hailing Jin, Riverside, CA (US); Chien Yu Huang, Riverside, CA (US)

(73) Assignee: THE REGENTS OF THE UNIVERSITY OF CALIFORNIA, Oakland, CA (US)

( * ) Notice: Subject to any disclaimer, the term of this patent is extended or adjusted under 35 U.S.C. 154(b) by 29 days.

(21) Appl. No.: 18/264,890

(22) PCT Filed: Feb. 9, 2022

(86) PCT No.: PCT/US2022/070589

§ 371 (c)(1),
(2) Date: Aug. 9, 2023

(87) PCT Pub. No.: WO2022/174232

PCT Pub. Date: Aug. 18, 2022

(65) Prior Publication Data

US 2024/0124887 A1 Apr. 18, 2024

Related U.S. Application Data

(60) Provisional application No. 63/147,452, filed on Feb. 9, 2021.

(51) Int. Cl.
*C12N 15/82* (2006.01)

(52) U.S. Cl.
CPC ................................ *C12N 15/8281* (2013.01)

(58) Field of Classification Search
None
See application file for complete search history.

(56) References Cited

U.S. PATENT DOCUMENTS

2025/0304991 A1* 10/2025 El-Mohtar ......... C12N 15/8203

FOREIGN PATENT DOCUMENTS

| | | | |
|---|---|---|---|
| WO | 2013055867 | A1 | 4/2013 |
| WO | 2016086142 | A1 | 6/2016 |
| WO | 2017044773 | A1 | 3/2017 |
| WO | 2019084040 | A1 | 5/2019 |

OTHER PUBLICATIONS

Bowman, K. NPL_USDA_RootstockReleases, https://www.ars.usda.gov/southeast-area/fort-pierce-fl/us-horticultural-research-laboratory/docs/rootstocks-released-by-dr-kim-bowman/ ; URL verified Jul. 24, 2025 (Year: 2010).*

Bowman, K. NPL_Taking Stock of New Citrus Rootstocks—Growing Produce_2010, https://www.growingproduce.com/citrus/varieties-rootstocks/taking-stock-of-new-citrus-rootstocks/ ; URL verified Jul. 24, 2025 (Year: 2010).*

U.S. Appl. No. 18/268,280, filed Dec. 17, 2021, Priority Application for US20250304991A1.*

U.S. Appl. No. 63/127,523, filed Dec. 18, 2020, Provisional Filing for U.S. Appl. No. 18/268,280.*

Shah et al. Predicting Enzyme Function from Sequence: A Systematic Appraisal. Proc Int Conf Intell Syst Mol Biol. 1997 ; 5: 276-283; Published Jul. 13, 2009 (Year: 2009).*

Joshi et al. Quantitative assessment of relationship between sequence similarity and function similarity BMC Genomics 2007, 8:222; Published Jul. 9, 2007 (Year: 2007).*

Bowman, Kim. NPL_USDA_RootstockReleases.pdf; Published 2010 (Year: 2010).*

Bowman, Kim. NPL_Taking New Stock of Citrus Rootstocks, Growing Produce_2010.pdf; Published May 23, 2010 (Year: 2010).*

Nehala, Y and Killiny, N. Revisiting the Complex Pathosystem of Huanglongbing: Deciphering the Role of Citrus Metabolites in Symptom Development. Metabolites 2020, 10, 409, p. 1-25; Published Oct. 13, 2020 (Year: 2020).*

European Patent Application No. EP22753548.1, “Partial Supplementary European Search Report”, dated Dec. 9, 2024, 18 pages.

Fu et al., “Transcriptome Analysis of Sweet Orange Trees Infected with ‘Candidatus Liberibacter Asiaticusi’ and Two Strains of Citrus Tristeza Virus”, BMC Genomics, vol. 17, No. 1, May 11, 2016, pp. 1-18.

Huang et al., “A Stable Antimicrobial Peptide with Dual Functions of Treating and Preventing Citrus Huanglongbing”, Proceedings of the National Academy of Sciences (PNAS), vol. 118, No. 6, XP093209105, Feb. 1, 2021, pp. 1-10.

Liu et al., “Comparative Transcriptional Profiling of Orange Fruit in Response to the Biocontrol Yeast and its Active Compounds”, BMC Genomics, vol. 17, No. 17, XP021232509, Jan. 4, 2016, pp. 1-14.

Lu et al., “Overexpression of a Citrus NDR1 Ortholog Increases Disease Resistance in *Arabidopsis*”, Frontiers in Plant Science, vol. 4, XP093227752, Jun. 3, 2013, pp. 1-10.

Wang et al., “CRISPR/Cas9-mediated editing of CsWRKY22 reduces susceptibility to *Xanthomonas citri* subsp. *citri* in Wanjincheng orange (*Citrus sinensis* (L.) Osbeck)”, Plant Biotechnology Reports, vol. 13, No. 5, XP037044370, Aug. 3, 2019, pp. 501-510.

Zhang , “59-P Regulation of Citrus DmR6 via RNA Interference and CRISPR/Cas9-Mediated Gene Editing to Improve Huanglongbing Tolerance”, Plant Health in a Global Economy, Jul. 30, 2018, pp. 1-2.

“BRCA1-Associated Protein [Citrus Sinensis]” , National Center for Biotechnology Information, Genbank entry , May 16, 2018 , 2 pages.

Huang et al. , “Identification of Citrus Immune Regulators Involved in Defence Against Huanglongbing using a New Functional Screening System” , Plant Biotechnology Journal, vol. 19, No. 4 , Oct. 2020 , pp. 757-766.

(Continued)

*Primary Examiner* — Amjad Abraham
*Assistant Examiner* — Keith R. Williams
(74) *Attorney, Agent, or Firm* — Viksnins Harris Padys Malen LLP

(57) ABSTRACT

The present disclosure provides methods and compositions for increasing resistance of plants to a disease caused by infection with bacteria of a *Liberibacter* species.

11 Claims, 11 Drawing Sheets

Specification includes a Sequence Listing.

(56) References Cited

OTHER PUBLICATIONS

Khafif et al. , "An Essential Role for the Vast Domain of the Arabidopsis VAD1 Protein in the Regulation of Defense and Cell Death in Response to Pathogens" , PLoS One, vol. 12, No. 7, Jul. 6, 2017 , pp. 1-18.
International Search Report and Written Opinion mailed Aug. 10, 2022, in PCT/US2022/070589, 15 pages.

* cited by examiner

IMMUNE REGULATORS INVOLVED IN DEFENSE AGAINST PLANT DISEASES CAUSED BY LIBERIBACTER SPECIES

CROSS-REFERENCE TO RELATED APPLICATIONS

This application is a U.S. National Stage of PCT/US2022/070589, international filing date Feb. 9, 2022, which claims priority benefit of U.S. Provisional Application No. 63/147,452, filed Feb. 9, 2021, each of which is incorporated by reference for all purposes.

REFERENCE TO SUBMISSION OF A SEQUENCE LISTING AS A TEXT FILE

The instant application contains a Sequence Listing which has been submitted electronically in ASCII format and is hereby incorporated by reference in its entirety. Said ASCII copy, created on Mar. 30, 2022, is named 081906-1300487-242110WO_SL.txt and is 2,444,009 bytes in size.

BACKGROUND

Citrus Greening Disease (Huanglongbing (HLB)), which is associated with the bacteria *Candidatus Liberibacter asiaticus*' (CLas) and is vectored by the Asian citrus psyllid (ACP), is the most devastating disease of citrus and has resulted in a significant reduction in citrus quality and quantity. HLB causes billions of dollars in losses of citrus products every year, and seriously impacts the viability of the citrus industry. Partial control is mainly achieved by removal of infected trees and chemical treatment against the insect vector. No efficient and sustainable disease control methods for HLB have been found. In Florida, more than 80% of the citrus groves have been infected by CLas since the first detection of HLB positive trees in 2005. Since then HLB has spread to Texas and California. Removing all of the infected trees is no longer a practical management strategy. Further, applying pesticides can only suppress the disease temporarily and is not an environmentally-friendly method as a long term solution.

Another important disease caused by a *Liberibacter* species is Potato Zebra Chip (ZC) disease (also called Potato Zebra complex disease). ZC disease is associated with *Candidatus Liberibacter solanacearum* (CLso), which is transmitted by potato psyllids (e.g., *Bactericera cockerelli*). ZC disease reached epidemic level in northern Texas in 2006 and has spread to Arizona, California, Colorado, Idaho, Oregon, Kansas, Nebraska, and New Mexico. ZC disease has caused millions of dollars loss to the potato industry in the southwestern United States, particularly Texas. In addition to potatoes, other solanaceous crops, including tomato, eggplant and pepper, can also be infected.

BRIEF SUMMARY

Through comparative analysis of small RNA pools between HLB-resistant/tolerant variety US942 and HLB-susceptible variety Cleopatra, we identified regulators that responded to HLB in US942 but not in Cleopatra. We predicted and annotated the possible immune negative and positive regulators, and repressed or evaluated the expression level in US942 and in another HLB-tolerant citrus relative, Sydney hybrid (*Microcitrus virgata*), which has a distinct genetic and geographic background compared to Cleopatra. Because the functional validation of candidate regulators in tree crops is always challenging and time-consuming, we developed a rapid functional screening method, using a similar parallel *C. Liberibacter solanacearum* (CLso)/potato psyllid/*Nicotiana benthamiana* interaction system to mimic the natural transmission and infection circuit of the HLB cost-effective screening method allows for rapid identification and functional characterization of regulators involved in plant immune responses against HLB. We performed functional testing in this pathosystem to identify positive defense regulators or negative immune suppressors. Accordingly, provided herein are methods and compositions for increasing the expression of positive defense regulators and/or inhibiting the expression of negative immune regulators to enhance resistance of a plant to *Liberibacter* infections, e.g., resistance to HLB, or to potato zebra chip disease.

In one aspect, provided herein is a method of enhancing resistance to HLB, the method comprising genetically modifying a plant, e.g., a plant of the citrus family or a solanaceous crop, to decrease expression of an endogenous gene encoding a negative regulator of immune response polypeptide, wherein the negative regulator of immune response polypeptide is a polypeptide listed in Table 1. In some embodiments, the negative regulator of immune response polypeptide is VAD1, PRT6, PUB26, PAO1, LIN2, CRWN, or GPX8. In some embodiments, decreasing expression of the negative regulator polypeptide comprises contacting the plant with siRNA that targets an endogenous nucleic acid encoding the negative regulator polypeptide. In some embodiments, decreasing expression of the negative regulator polypeptide comprises viral vector-mediated gene silencing. In some embodiments, decreasing expression of the negative regulator polypeptide comprises knocking out expression of the endogenous gene encoding the negative regulator. In some embodiments, the method comprises gene editing the endogenous gene to decrease or knockout expression, e.g., using CRISPR/CAS gene editing. In some embodiments, the negative regulator of immune response polypeptide comprises an amino acid sequence that is identical to, or is at least 70%, 75%, 80%, or 85% identical to, or at least 90% or at least 95% identical to, a polypeptide sequence listed in Table 3. In some embodiments, the negative regulator of immune response polypeptide comprises an amino acid sequence that is identical to, or is at least 70%, 75%, 80%, or 85% identical, or at least 90% or at least 95% identical, to a VAD1, PRT6, PUB26, PAO1, LIN2, CRWN, or GPX8 polypeptide sequence as set forth in Table 3. In some embodiments, the plant is a *Citrus maxima, Citrus medica, Citrus micrantha, Citrus reticulata, Citrus aurantiifolia, Citrus aurantium, Citrus latifolia, Citrus limon, Citrus limonia, Citrus paradisi, Citrus clementina, Citrus unshiu, Citrus sinensis, Citrus tangerina, Citrus ichangensis, Atalantia buxifolia*, or *Poncirus trifoliata* plant. In some embodiments, the plant a variety of potato or tomato. In some embodiments, the plant is a pepper variety.

In a further aspect, provided herein is a method of enhancing resistance to HLB, the method comprising genetically modifying a plant e.g., a plant of the citrus family or a solanaceous crop, to overexpress a gene encoding a positive defense regulator polypeptide set forth in Table 2. In some embodiments, the positive defense regulator peptide is BRAP2, NDR1-like, or PSL4. In some embodiments, the method comprises genetically modifying a plant to overexpress a polypeptide comprising an amino acid sequence that is identical to, or has at least 70%, 75%, 80%, or 85% identity; or at least 90% or 95% identity, to a polypeptide set forth in Table 4. In some embodiments, the polypeptide is identical to, or has at least 70%, 75%, 80%, or 85% identity, or at least 90% identity, or at least 95% identity to a BRAP2, NDR1-like, or PSL4 polypeptide sequence set forth in Table 4. In some embodiments, the polypeptide is endogenous to the plant. Alternatively, the polypeptide can be heterologous to the plant. In some embodiments, the plant is a *Citrus maxima, Citrus medica, Citrus micrantha, Citrus reticulata, Citrus aurantiifolia, Citrus aurantium, Citrus latifolia, Citrus limon, Citrus limonia, Citrus paradisi, Citrus clementina, Citrus unshiu, Citrus sinensis, Citrus tangerina, Citrus ichangensis, Atalantia buxifolia*, or *Poncirus trifoliata* plant. In some embodiments, the plant a variety of potato or tomato. In some embodiments, the plant is a pepper variety.

In a further aspect, the disclosure provides a plant having enhanced resistance to HLB generated by a method targeting a gene as described herein, e.g., in the preceding two paragraphs.

DETAILED DESCRIPTION

Figure 1A:
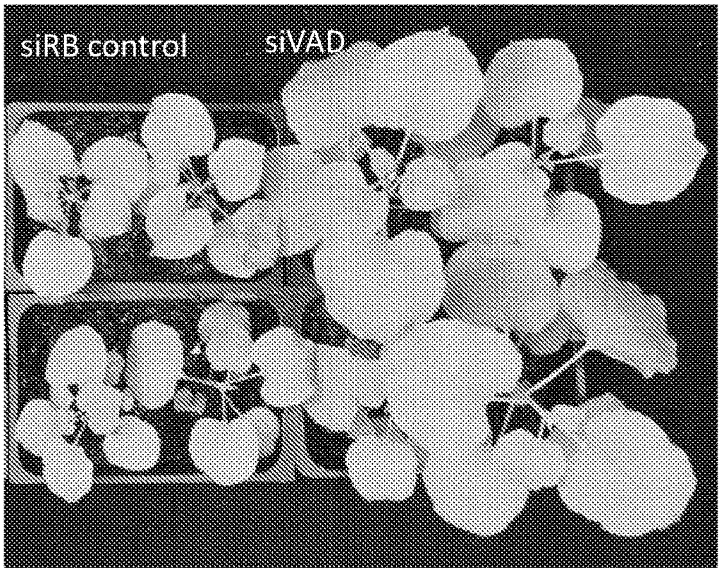
FIG. 1*a-c*: Nb/pysllid/CLso pathosystem combined with viral-induced gene silencing (VIGS) showed that VAD is a negative regulator in response to CLso infection. a) Two-week-old Nb plants were exposed to CLso positive potato psyllids for 5 days and VAD expression was knocked down by VIGS. Silencing RB gene (iRB control) was used as a control in non-silenced plants. b) Details of leaves from panel a. c) CLso bacteria titer measured by probe-based qPCR in 50 ng host genomic DNA. The significant difference is analyzed by student's t-test (*P<0.01).

The present disclosure provides targets for modulating the immune response pathways to enhance resistance to HLB.

The invention employs various routine recombinant nucleic acid techniques. Generally, the nomenclature and the laboratory procedures in recombinant DNA technology described below are commonly employed in the art. Many manuals that provide direction for performing recombinant DNA manipulations are available, e.g., Sambrook & Russell, Molecular Cloning, A Laboratory Manual (3rd Ed, 2001); and Current Protocols in Molecular Biology (Ausubel, et al., John Wiley and Sons, New York, 2009-2014).

As used herein, the terms "citrus greening disease" and "Huanglongbing (HLB)" refer to a bacterial infection of plants (e.g., citrus plants) caused by bacteria in the genus *Candidatus Liberibacter* (*Candidatus Liberibacter asiaticus, Candidatus Liberibacter africanus*, and *Candidatus Liberibacter americanus*). The infection is vectored and transmitted by the Asian citrus psyllid, *Diaphorina citri*, and the African citrus psyllid, *Trioza erytreae*. Three different types of HLB are currently known: the heat-tolerant Asian form, and the heat-sensitive African and American forms.

The term "HLB-resistant/tolerant" or "HLB resistance/tolerance" refers to an increase in the ability of a citrus plant comprising one or more genetic modifications described herein to prevent or resist HLB infection or HLB-induced symptoms of infection in response to a corresponding control citrus plant that does not comprise the genetic modification(s). An "HLB-resistant" plant thus can have increased tolerance to HLB compared to the control citrus plant. Accordingly, unless otherwise specified, the term "HLB-resistant" includes plants that are tolerant to HLB, e.g., can the citrus plant can grow and produce fruit despite being infected with HLB. The term "HLB-resistant/tolerant" and "HLB-resistant" are thus used interchangeably herein to refer to a plant that has an increase in the ability to prevent HLB infection or has a reduction in one or more HLB-induced symptoms of infection.

The term "negative immune suppressor" or "negative immune response regulator" or "negative regulator of immune response" refers to a gene, or a polypeptide encoded by the gene, that decreases host defense responses, i.e., reduces one or more aspect of a plant immune response to CLas infection, such that the plant has increased susceptibility to HLB. A listing of negative immune suppressors is provided in Table 1. Illustrative polypeptide sequences are provided in Table 3.

The term "positive defense regulator" refers to a gene, or a polypeptide encoded by the gene, that enhances host defense responses, i.e., enhances one or more aspect of a plant immune response to CLas infection, such that the plant has increased resistance/tolerance to HLB. A listing of positive defense regulators is in Table 2. Illustrative polypeptide sequences are provided in Table 4.

The term "nucleic acid" or "polynucleotide" refers to a single or double-stranded polymer of deoxyribonucleotide or ribonucleotide bases read from the 5' to the 3' end. Nucleic acids may also include modified nucleotides that permit correct read through by a polymerase and do not significantly alter expression of a polypeptide encoded by that nucleic acid.

The phrase "nucleic acid encoding" or "polynucleotide encoding" refers to a nucleic acid which directs the expression of a specific protein or peptide. The nucleic acid sequences include both the DNA strand sequence that is transcribed into RNA and the RNA sequence that is translated into protein. The nucleic acid sequences include both the full length nucleic acid sequences as well as non-full length sequences derived from the full length sequences. It should be further understood that the sequence includes the degenerate codons of the native sequence or sequences which may be introduced to provide codon preference in a specific host cell.

Two nucleic acid sequences or polypeptides are said to be "identical" if the sequence of nucleotides or amino acid residues, respectively, in the two sequences is the same when aligned for maximum correspondence as described below. "Percentage of sequence identity" is determined by comparing two optimally aligned sequences over a comparison window, wherein the portion of the polynucleotide or polypeptide sequence in the comparison window may comprise additions or deletions (i.e., gaps) as compared to the reference sequence (which does not comprise additions or deletions) for optimal alignment of the two sequences. The percentage is calculated by determining the number of positions at which the identical nucleic acid base or amino acid residue occurs in both sequences to yield the number of matched positions, dividing the number of matched positions by the total number of positions in the window of comparison and multiplying the result by 100 to yield the percentage of sequence identity. When percentage of sequence identity is used in reference to proteins or peptides, it is recognized that residue positions that are not identical often differ by conservative amino acid substitutions, where amino acid residues are substituted for other amino acid residues with similar chemical properties (e.g., charge or hydrophobicity) and therefore do not change the functional properties of the molecule. Where sequences differ in conservative substitutions, the percent sequence identity may be adjusted upwards to correct for the conservative nature of the substitution. Means for making this adjustment are well known to those of skill in the art. Typically this involves scoring a conservative substitution as a partial rather than a full mismatch, thereby increasing the percentage sequence identity. Thus, for example, where an identical amino acid is given a score of 1 and a non-conservative substitution is given a score of zero, a conservative substitution is given a score between zero and 1. The scoring of conservative substitutions is calculated according to, e.g., the algorithm of Meyers & Miller, *Computer Applic. Biol. Sci.* 4:11-17 (1988) e.g., as implemented in the program PC/GENE (Intelligenetics, Mountain View, California, USA).

The term "substantial identity" or "substantially identical," as used in the context of polynucleotide or polypeptide sequences, refers to a sequence that has at least 60% sequence identity to a reference sequence. Alternatively, percent identity can be any integer from 60% to 100%. Exemplary embodiments include at least: 60%, 65%, 70%, 75%, 80%, 85%, 90%, 91%, 92%, 93%, 94%, 95%, 96%, 97%, 98%, or 99%, as compared to a reference sequence using the programs described herein; preferably BLAST using standard parameters, as described below. One of skill will recognize that these values can be appropriately adjusted to determine corresponding identity of proteins encoded by two nucleotide sequences by taking into account codon degeneracy, amino acid similarity, reading frame positioning and the like.

For sequence comparison, typically one sequence acts as a reference sequence to which test sequences are compared. When using a sequence comparison algorithm, test and reference sequences are entered into a computer, subsequence coordinates are designated, if necessary, and sequence algorithm program parameters are designated. Default program parameters can be used, or alternative parameters can be designated. The sequence comparison algorithm then calculates the percent sequence identities for the test sequences relative to the reference sequence, based on the program parameters.

A "comparison window," as used herein, includes reference to a segment of any one of the number of contiguous positions selected from the group consisting of from 20 to 600, usually about 50 to about 200, more usually about 100 to about 150 in which a sequence may be compared to a reference sequence of the same number of contiguous positions after the two sequences are optimally aligned. Methods of alignment of sequences for comparison are well-known in the art. Optimal alignment of sequences for comparison may be conducted by the local homology algorithm of Smith and Waterman *Add. APL. Math.* 2:482 (1981), by the homology alignment algorithm of Needleman and Wunsch *J. Mol. Biol.* 48:443 (1970), by the search for similarity method of Pearson and Lipman *Proc. Natl. Acad. Sci.* (*U.S.A.*) 85:2444 (1988), by computerized implementations of these algorithms (GAP, BESTFIT, BLAST, FASTA, and TFASTA in the Wisconsin Genetics Software Package, Genetics Computer Group (GCG), 575 Science Dr., Madison, WI), or by manual alignment and visual inspection.

Algorithms that are suitable for determining percent sequence identity and sequence similarity are the BLAST and BLAST 2.0 algorithms, which are described in Altschul et al. (1990) *J. Mol. Biol.* 215:403-410 and Altschul et al. (1977) *Nucleic Acids Res.* 25:3389-3402, respectively. Software for performing BLAST analyses is publicly available through the National Center for Biotechnology Information (NCBI) web site. The algorithm involves first identifying high scoring sequence pairs (HSPs) by identifying short words of length W in the query sequence, which either match or satisfy some positive-valued threshold score T when aligned with a word of the same length in a database sequence. T is referred to as the neighborhood word score threshold (Altschul et al, supra). These initial neighborhood word hits acts as seeds for initiating searches to find longer HSPs containing them. The word hits are then extended in both directions along each sequence for as far as the cumulative alignment score can be increased. Cumulative scores are calculated using, for nucleotide sequences, the parameters M (reward score for a pair of matching residues; always >0) and N (penalty score for mismatching residues; always <0). For amino acid sequences, a scoring matrix is used to calculate the cumulative score. Extension of the word hits in each direction are halted when: the cumulative alignment score falls off by the quantity X from its maximum achieved value; the cumulative score goes to zero or below, due to the accumulation of one or more negative-scoring residue alignments; or the end of either sequence is reached. The BLAST algorithm parameters W, T, and X determine the sensitivity and speed of the alignment. The BLASTN program (for nucleotide sequences) uses as defaults a word size (W) of 28, an expectation (E) of 10, M=1, N=−2, and a comparison of both strands. For amino acid sequences, the BLASTP program uses as defaults a word size (W) of 3, an expectation (E) of 10, and the BLOSUM62 scoring matrix (see Henikoff & Henikoff, *Proc. Natl. Acad. Sci. USA* 89:10915 (1989)). For purposes of this application, amino acid sequence identity is determined using BLASTP with default parameters.

The BLAST algorithm also performs a statistical analysis of the similarity between two sequences (see, e.g., Karlin & Altschul, *Proc. Nat'l. Acad. Sci. USA* 90:5873-5787 (1993)). One measure of similarity provided by the BLAST algorithm is the smallest sum probability (P(N)), which provides an indication of the probability by which a match between two nucleotide or amino acid sequences would occur by chance. For example, a nucleic acid is considered similar to a reference sequence if the smallest sum probability in a comparison of the test nucleic acid to the reference nucleic acid is less than about 0.01, more preferably less than about $10^{-5}$, and most preferably less than about $10^{-20}$.

The term "complementary to" is used herein to mean that a polynucleotide sequence is complementary to all or a portion of a reference polynucleotide sequence. In some embodiments, a polynucleotide sequence is complementary to at least 15, at least 20, at least 25, at least 30, at least 40, at least 50, at least 75, at least 100, at least 125, at least 150, at least 175, at least 200, or more contiguous nucleotides of a reference polynucleotide sequence. In some embodiments, a polynucleotide sequence is "substantially complementary" to a reference polynucleotide sequence if at least 70%, at least 75%, at least 80%, at least 85%, at least 90%, or at least 95% of the polynucleotide sequence is complementary to the reference polynucleotide sequence.

A polynucleotide sequence is "heterologous" to an organism or a second polynucleotide sequence if it originates from a foreign species, or, if from the same species, is modified from its original form. For example, when a promoter is said to be operably linked to a heterologous coding sequence, it means that the coding sequence is derived from one species whereas the promoter sequence is derived another, different species; or, if both are derived from the same species, the coding sequence is not naturally associated with the promoter (e.g., is a genetically engineered coding sequence, e.g., from a different gene in the same species, or an allele from a different ecotype or variety).

An "expression cassette" refers to a nucleic acid construct that, when introduced into a host cell, results in transcription and/or translation of an RNA or polypeptide, respectively. Antisense or sense constructs that are not or cannot be translated are expressly included by this definition. In the case of both expression of transgenes and suppression of endogenous genes (e.g., by antisense, or sense suppression) one of skill will recognize that the inserted polynucleotide sequence need not be identical, but may be only substantially identical to a sequence of the gene from which it was derived.

The term "promoter," as used herein, refers to a polynucleotide sequence capable of driving transcription of a coding sequence in a cell. Thus, promoters used in the polynucleotide constructs of the invention include cis-acting transcriptional control elements and regulatory sequences that are involved in regulating or modulating the timing and/or rate of transcription of a gene. For example, a promoter can be a cis-acting transcriptional control element, including an enhancer, a promoter, a transcription terminator, an origin of replication, a chromosomal integration sequence, 5' and 3' untranslated regions, or an intronic sequence, which are involved in transcriptional regulation. These cis-acting sequences typically interact with proteins or other biomolecules to carry out (turn on/off, regulate, modulate, etc.) gene transcription. A "plant promoter" is a promoter capable of initiating transcription in plant cells. A "constitutive promoter" is one that is capable of initiating transcription in nearly all tissue types, whereas a "tissue-specific promoter" initiates transcription only in one or a few particular tissue types. An "inducible promoter" is one that initiates transcription only under particular environmental conditions or developmental conditions.

The term "plant" includes whole plants, shoot vegetative organs and/or structures (e.g., leaves, stems and tubers), roots, flowers and floral organs (e.g., bracts, sepals, petals, stamens, carpels, anthers), ovules (including egg and central cells), seed (including zygote, embryo, endosperm, and seed coat), fruit (e.g., the mature ovary), seedlings, plant tissue (e.g., vascular tissue, ground tissue, and the like), cells (e.g., guard cells, egg cells, trichomes and the like), and progeny of same.

DETAILED DESCRIPTION OF THE INVENTION

Introduction

As described in the Examples section below, negative regulators of the immune response to *Liberibacter* infection, e.g., HLB or potato zebra chip disease, and positive defense regulators of the immune response against *Liberibacter* infection were identified using a screening technique. Described herein are methods and compositions for enhancing citrus plant resistance/tolerance to HLB by genetically modifying the citrus plant to silence, inhibit, or decrease expression or activity of a negative regulator of the immune response; and/or genetically modifying the citrus plant to increase expression or activity of a positive defense regulator. Similarly, a solanaceous crop plant, such as potato or tomato, can be modified to decrease and/or increase expression of an immune regulator polypeptide described herein.

In any of the compositions or methods described in the present disclosure, any plant species can be used, but in preferred embodiments, the plant is a member of the citrus family, e.g., a *Citrus maxima, Citrus medica, Citrus micrantha, Citrus reticulata, Citrus aurantiifolia, Citrus aurantium, Citrus latifolia, Citrus limon, Citrus limonia, Citrus paradisi, Citrus clementina, Citrus unshiu, Citrus sinensis, Citrus tangerina, Citrus ichangensis,* *Atalantia buxifolia*, or *Poncirus trifoliata* plant. In some embodiments, the plant a variety of potato or tomato. In some embodiments, the plant is a pepper variety.

Negative Regulators of the Immune Response

In some embodiments, provided herein are methods and compositions to inhibit expression of one or more negative regulators of plant immunity genes as set forth in Table 1. Illustrative polypeptide sequences for various citrus species are provided in Table 3.

TABLE 1

Negative regulators of plant immune responses against HLB. These genes were targeted by small RNAs induced by CLas infection in US942 but not in Cleopatra

| Gene | Annotation | Target by sRNAs |
|---|---|---|
| Ciclev10019258m | VAD1 | 942si2047 |
| Ciclev10013610m | Proteolysis 6, PRT6 | 942si2003 and 942si2020 |
| Ciclev10010604m Ciclev10027961m; Ciclev10014497m | OLIGOPEPTIDE TRANSPORTER 1; OPT1; YSL6 | 942si2003 and 942si2005 |
| Ciclev10028522m | PUB26 | 942si2009 and 942si2049 |
| Ciclev10027096m | DMR6 | 942si2012 |
| Ciclev10031331m | PAO1 | 942si2013 and 942si2025 |
| Ciclev10000377m; Ciclev10000246m; Ciclev10000247m; Ciclev10000248m | TPS5 | 942si2008 and 942si2032 |
| Ciclev10030586m | ACA11 | 942si2009 |
| Ciclev10030706m | MKP1 | 942si2014 |
| Ciclev10001632m; Ciclev10001298m | CRT1, CRT1a | 942si2016 |
| Ciclev10011903m | CPO-I, HEMF1, LIN2 | 942si2019 |

TABLE 1-continued

Negative regulators of plant immune responses against HLB. These genes were targeted by small RNAs induced by CLas infection in US942 but not in Cleopatra

| Gene | Annotation | Target by sRNAs |
|---|---|---|
| Ciclev10024751m; Ciclev10024754m; Ciclev10024753m | LINC4, CRWN | 942si2020 |
| Ciclev10022871m; Ciclev10022795m | GPX8 | 942si2023 |
| Ciclev10014207m; Ciclev10014574m | LOX2 | 942si2024 |
| Ciclev10027664m | PI4K ALPHA | 942si2035 |

Expression or activity of the negative regulator of immune response proteins described herein can be inhibited or knocked out using known methods. Thus, one, or more than one, of the genes provided in Table 1 can be knocked out or mutated to enhance HLB resistance. For example, in some embodiments, the native gene that encodes a polypeptide identical to or substantially identical (e.g., at least 70, 75, 80, 85, 90% identical, or at least 95% identical) to a VAD1, PRT6, OPTI, YSL6, PUB26, DMR6, PAO1, TPS5, ACA11, MPK1, CRT1, LIN2, CRWN (LINC4), GPX8, LOX2, or PI4K polypeptide sequence as set forth in Table 3 is mutated or knocked out in a citrus family plant. In some embodiments, the native gene that encodes a polypeptide identical or substantially identical (e.g., at least 70, 75, 80, 85, 90% identical, or at least 95% identical) to a VAD1, PRT6, PUB26, PAO1, LIN2, CRWN (LINC4), or GPX8 polypeptide sequence as set forth in Table 3 is mutated or knocked out in a citrus family plant. Gene sequences can be readily identified in other citrus species in view of known genome sequences and the conserved nature of the proteins.

In some embodiments, the gene sequence is knocked out in the plant. "Knocked out" in the context of this application means that the plant does not make the particular protein encoded by the gene. "Knocked down" means that the level of expression or the level of the protein or activity of the protein is reduced in a plant relative to a corresponding control wildtype plant. Knock outs and knock downs can be generated in a variety of ways. For example, a knock out plant can be generated by a deletion of all or a substantial part (e.g., majority) or the coding sequence for a polypeptide identical or substantially identical to a protein encoded by a gene set forth in Table 1, or to any one of the VAD1, PRT6, OPTI, YSL6, PUB26, DMR6, PAO1, TPS5, ACA11, MPK1, CRT1, LIN2, CRWN (LINC4), GPX8, LOX2, or PI4K polypeptide sequences set forth in Table 3. In some embodiments, a promoter sequence may be modified or deleted such that expression is eliminated or reduced. In some embodiments, knock out or knock down of the target is achieved by introduction of a mutation that prevents translation or transcription (e.g., a mutation that introduces a stop codon early in the coding sequence or that disrupts transcription). A knock out or knock down can also be achieved by silencing or other suppression methods, e.g., such that the plant expresses substantially less of the native protein (e.g., less than 50, 25, 10, 5, or 1% of native expression). A knockout or knockdown can also be achieved by CRISPR-CAS-mediated mutations and deletion, or by the use of alternative gene editing techniques further described below.

In some embodiments, a mutation introduced into the protein is a single amino acid change that reduces or eliminates the protein's activity. Alternatively, the mutation can include any number (e.g., 1, 2, 3, 4, 5, 6, 7, 8, 9, or 10 or more) of amino acid changes, deletions or insertions that reduce or eliminate the protein activity.

Methods for introducing genetic mutations into plant genes and selecting plants with desired traits are well known and can be used to introduce mutations or to knock out or knock down expression or activity of a protein. For instance, seeds or other plant material can be treated with a mutagenic insertional polynucleotide (e.g., transposon, T-DNA, etc.) or chemical substance, according to standard techniques. Such chemical substances include, but are not limited to, the following: diethyl sulfate, ethylene imine, ethyl methanesulfonate and N-nitroso-N-ethylurea. Alternatively, ionizing radiation from sources such as, X-rays or gamma rays can be used. Plants having mutated protein can then be identified, for example, by phenotype or by molecular techniques.

Modified protein chains can also be readily designed utilizing various recombinant DNA techniques well known to those skilled in the art and described for instance, in Sambrook et al., supra. Hydroxylamine can also be used to introduce single base mutations into the coding region of the gene (Sikorski et al., *Meth. Enzymol.,* 194:302-318 (1991)). For example, the chains can vary from the naturally occurring sequence at the primary structure level by amino acid substitutions, additions, deletions, and the like. These modifications can be used in a number of combinations to produce the final modified protein chain.

Alternatively, homologous recombination can be used to induce targeted gene modifications or knockouts by specifically targeting the gene in vivo (see, generally, Grewal and Klar, *Genetics,* 146:1221-1238 (1997) and Xu et al., *Genes Dev.,* 10:2411-2422 (1996)). Homologous recombination has been demonstrated in plants (Puchta et al., *Experientia,* 50:277-284 (1994); Swoboda et al., *EMBO J.,* 13:484-489 (1994); Offringa et al., *Proc. Natl. Acad. Sci. USA,* 90:7346-7350 (1993); and Kempin et al., *Nature,* 389:802-803 (1997)).

In applying homologous recombination technology to a gene, mutations in selected portions of gene sequences (including 5' upstream, 3' downstream, and intragenic regions) can be made in vitro and then introduced into the desired plant using standard techniques. Since the efficiency of homologous recombination is known to be dependent on the vectors used, use of dicistronic gene targeting vectors as described by Mountford et al., *Proc. Natl. Acad. Sci. USA,* 91:4303-4307 (1994); and Vaulont et al., *Transgenic Res.,* 4:247-255 (1995) are conveniently used to increase the efficiency of selecting for altered PP2A subunit A protein gene expression in transgenic plants. The mutated gene will interact with the target wild-type gene in such a way that homologous recombination and targeted replacement of the wild-type gene will occur in transgenic plant cells, resulting in suppression of target protein activity.

Any of a number of genome-editing techniques known to those of skill in the art can be used to mutate or knock out the target protein. The particular genome-editing technique used is not critical, so long as it provides site-specific mutation of a desired nucleic acid sequence. Exemplary genome-editing proteins include targeted nucleases such as engineered zinc finger nucleases (ZFNs), transcription-activator-like effector nucleases (TALENs), and engineered meganucleases. In addition, systems which rely on an engineered guide RNA (a gRNA) to guide an endonuclease to a target cleavage site can be used. The most commonly used of these systems is the CRISPR/Cas system with an engineered guide RNA to guide the Cas-9 or Cas12 endonuclease to the target cleavage site.

CRISPR (Clustered Regularly Interspaced Short Palindromic Repeats)/Cas (CRISPR-associated) system, are adaptive defense systems in prokaryotic organisms that cleave foreign DNA. CRISPR loci in microbial hosts contain a combination of CRISPR-associated (Cas) genes as well as non-coding RNA elements which determine the specificity of the CRISPR-mediated nucleic acid cleavage. Three types (I-III) of CRISPR systems have been identified across a wide range of bacterial hosts. In a typical system, a Cas endonuclease (e.g., Cas9) is guided to a desired site in the genome using small guide RNAs that target sequence-specific single- or double-stranded DNA sequences. The CRISPR/Cas system has been used to induce site-specific mutations, including deletions, in plants (see Miao et al. 2013 *Cell Research* 23:1233-1236).

The basic CRISPR system uses two non-coding guide RNAs (crRNA and tracrRNA) which form a crRNA: tracrRNA complex that directs the nuclease to the target DNA via Wastson-Crick base-pairing between the crRNA and the target DNA. Thus, the guide RNAs can be modified to recognize any desired target DNA sequence. More recently, it has been shown that a Cas nuclease can be targeted to the target gene location with a chimeric single-guide RNA (sgRNA) that contains both the crRNA and tracRNA elements. It has been shown that Cas9 or Cas12 and the like, can be targeted to desired gene locations in a variety of organisms with a chimeric sgRNA (Cong et al. 2013 *Science* 339:819-23).

Zinc finger nucleases (ZFNs) are engineered proteins comprising a zinc finger DNA-binding domain fused to a nucleic acid cleavage domain, e.g., a nuclease. The zinc finger binding domains provide specificity and can be engineered to specifically recognize any desired target DNA sequence. For a review of the construction and use of ZFNs in plants and other organisms, see Urnov et al. 2010 Nat Rev Genet. 11 (9): 636-46.

Transcription activator like effectors (TALEs) are proteins secreted by certain species of *Xanthomonas* to modulate gene expression in host plants and to facilitate bacterial colonization and survival. TALEs act as transcription factors and modulate expression of resistance genes in the plants. Recent studies of TALEs have revealed the code linking the repetitive region of TALES with their target DNA-binding sites. TALEs comprise a highly conserved and repetitive region consisting of tandem repeats of mostly 33 or 34 amino acid segments. The repeat monomers differ from each other mainly at amino acid positions 12 and 13. A strong correlation between unique pairs of amino acids at positions 12 and 13 and the corresponding nucleotide in the TALE-binding site have been found. The simple relationship between amino acid sequence and DNA recognition of the TALE binding domain allows for the design DNA binding domains of any desired specificity.

TALEs can be linked to a non-specific DNA cleavage domain to prepare genome-editing proteins, referred to as TALENs. As in the case of ZFNs, a restriction endonuclease, such as FokI, can be conveniently used. For a description of the use of TALENs in plants, see Mahfouz et al. 2011 *Proc Natl Acad Sci USA.* 108:2623-8 and Mahfouz 2011 *GM Crops.* 2:99-103.

Meganucleases are endonucleases that have a recognition site of 12 to 40 base pairs. As a result, the recognition site occurs rarely in any given genome. By modifying the recognition sequence through protein engineering, the targeted sequence can be changed and the nuclease can be used to cleave a desired target sequence. (See Seligman, et al.

2002 Nucleic Acids Research 30: 3870-9 WO06097853, WO06097784, WO04067736, or US20070117128).

In addition to the methods described above, other methods for introducing genetic mutations into plant genes and selecting plants with desired traits are known. For instance, seeds or other plant material can be treated with a mutagenic chemical substance, according to standard techniques. Such chemical substances include, diethyl sulfate, ethylene imine, ethyl methanesulfonate (EMS) and N-nitroso-N-ethylurea. Alternatively, ionizing radiation from sources such as, X-rays or gamma rays can be used.

Also provided are methods of suppressing expression or activity of a polypeptide identical to, or substantially identical, e.g., at least 70, 75, 80, 85, or 90% identical; or at least to 95% identical, to a protein encoded by a gene set forth in Table 1 or a to a VAD1, PRT6, OPTI, YSL6, PUB26, DMR6, PAO1, TPS5, ACA11, MPK1, CRT1, LIN2, CRWN (LINC4), GPX8, LOX2, or PI4K polypeptide sequence as set forth in Table 3, in a citrus plant using expression cassettes that express RNA molecules (or fragments thereof) that inhibit endogenous target gene expression or activity in a plant cell. Suppressing or silencing gene function refers generally to the suppression of levels of mRNA or protein expressed by the endogenous gene and/or the level of the protein functionality in a cell. The terms do not require specific mechanism and could include RNAi (e.g., short interfering RNA (siRNA) and microRNA (miRNA)), antisense, cosuppression, viral-suppression, hairpin suppression, stem-loop suppression, and the like.

A number of methods can be used to suppress or silence gene expression in a plant. The ability to suppress gene function in a variety of organisms, including plants, using double stranded RNA is well known. Expression cassettes encoding RNAi typically comprise a polynucleotide sequence at least substantially identical to the target gene linked to a complementary polynucleotide sequence. The sequence and its complement are often connected through a linker sequence that allows the transcribed RNA molecule to fold over such that the two sequences hybridize to each other.

RNAi (e.g., siRNA, miRNA) appears to function by base-pairing to complementary RNA or DNA target sequences. When bound to RNA, the inhibitory RNA molecules trigger either RNA cleavage or translational inhibition of the target sequence. When bound to DNA target sequences, it is thought that inhibitory RNAs can mediate DNA methylation of the target sequence. The consequence of these events, regardless of the specific mechanism, is that gene expression is inhibited. RNA silencing can also be achieved by expressing the target gene or part of the target gene in a virus vector, such as tobacco rattle virus (TRV), Potato virus X (PVX), or Citrus Tristeza Virus (CTV), which can trigger virus-induced gene silencing (VIGS) of the target gene.

MicroRNAs (miRNAs) are non-coding RNAs of about 19 to about 24 nucleotides in length that are processed from longer precursor transcripts that form stable hairpin structures.

In addition, antisense technology can be employed. To accomplish this, a nucleic acid segment at least substantially identical to the desired gene is cloned and operably linked to a promoter such that the antisense strand of RNA will be transcribed. The expression cassette is then transformed into a plant and the antisense strand of RNA is produced. In plant cells, it has been suggested that antisense RNA inhibits gene expression by preventing the accumulation of mRNA which encodes the protein of interest.

Another method of suppression is sense suppression. Introduction of expression cassettes in which a nucleic acid is configured in the sense orientation with respect to the promoter has been shown to be an effective means by which to block the transcription of target genes.

For these techniques, the introduced sequence in the expression cassette need not have absolute identity to the target gene. In addition, the sequence need not be full length, relative to either the primary transcription product or fully processed mRNA. One of skill in the art will also recognize that using these technologies families of genes can be suppressed with a transcript. For instance, if a transcript is designed to have a sequence that is conserved among a family of genes, then multiple members of a gene family can be suppressed. Conversely, if the goal is to only suppress one member of a homologous gene family, then the transcript should be targeted to sequences with the most variance between family members.

Gene expression can also be inactivated using recombinant DNA techniques by transforming plant cells with constructs comprising transposons or T-DNA sequences. Mutants prepared by these methods are identified according to standard techniques. For instance, mutants can be detected by PCR or by detecting the presence or absence of PP2A subunit A mRNA, e.g., by northern blots or reverse transcription PCR (RT-PCR).

Catalytic RNA molecules or ribozymes can also be used to inhibit expression of embryo-specific genes. It is possible to design ribozymes that specifically pair with virtually any target RNA and cleave the phosphodiester backbone at a specific location, thereby functionally inactivating the target RNA. In carrying out this cleavage, the ribozyme is not itself altered, and is thus capable of recycling and cleaving other molecules, making it a true enzyme. The inclusion of ribozyme sequences within antisense RNAs confers RNA cleaving activity upon them, thereby increasing the activity of the constructs. The design and use of target RNA-specific ribozymes is well known.

The recombinant construct encoding a genome-editing protein or a nucleic acid that suppresses expression may be introduced into the plant cell using standard genetic engineering techniques, well known to those of skill in the art. In the typical embodiment, recombinant expression cassettes can be prepared according to well-known techniques. In the case of CRISPR/Cas nuclease, the expression cassette may transcribe the guide RNA, as well.

In some embodiments, the genome-editing protein itself, is introduced into the plant cell. In these embodiments, the introduced genome-editing protein is provided in sufficient quantity to modify the cell but does not persist after a contemplated period of time has passed or after one or more cell divisions. In such embodiments, no further steps are needed to remove or segregate away the genome editing protein and the modified cell.

In these embodiments, the genome editing protein is prepared in vitro prior to introduction to a plant cell using well known recombinant expression systems (bacterial expression, in vitro translation, yeast cells, insect cells and the like). After expression, the protein is isolated, refolded if needed, purified and optionally treated to remove any purification tags, such as a His-tag. Once crude, partially purified, or more completely purified genome editing proteins are obtained, they may be introduced to a plant cell via electroporation, by bombardment with protein coated particles, by chemical transfection or by some other means of transport across a cell membrane.

Positive Regulators of the Immune response

In some embodiments, provided herein are methods and compositions to enhance expression of one or more positive defense plant genes as set forth in Table 2. Illustrative polypeptide sequences various citrus species are provided in Table 4.

TABLE 2

Positive regulators of plant immune responses against HLB. These genes were targeted by small RNAs down-regulated by CLas infection in US942 but not in Cleopatra

| Gene | Annotation | Target by sRNAs |
|---|---|---|
| Ciclev10008403m | BRAP2 | 942si1001 |
| Ciclev10019811m | CYP450, CYP93 | 942si1020 |
| Ciclev10012768m | NDR1-like; NHL1 | 942si1026 |
| Ciclev10014526m | PSL4 | 942si1003 |
| Ciclev10028533m | LYM2 | 942si1003 |
| Ciclev10017680m | SOT12 | 942si1005 |
| Ciclev10002823m; Ciclev10002741m; Ciclev10002866m | AHUS5, EMB1637, SCE1, SCE1A | 942si1006 |
| Ciclev10031485m | GLY1, SFD1 | 942si1009 |
| Ciclev10011175m | PAL1 | 942si1009 |
| Ciclev10012055m | WRKY70 | 942si1017 |
| Ciclev10033608m | EFR-like | 942si1002 |

Expression of the proteins described herein can be increased using known techniques. Any one, or more than one, of the genes provided in Table 4 can be overexpressed in a plant to enhance HLB resistance. Thus, in some embodiments, a plant can be genetically modified to overexpress the gene native to the plant or to express a corresponding heterologous gene from another species. In some embodiments, a citrus plant is engineered to overexpress a polypeptide identical to or substantially identical (e.g., at least 70, 75, 80, 85, 90% identical, or at least 95% identical) to a BRAP2, CYP93, NDR1-like, PSL4, LYM2, SOT12, SCE1, GLY1, PAL1, WRKY70, or EFR-like polypeptide sequence as set forth in Table 4. In some embodiments, a citrus plant is engineered to overexpress a polypeptide identical to or substantially identical (e.g., at least 70, 75, 80, 85, 90% identical, or at least 95% identical) to a BRAP2, NDR1-like, or PSL4 polypeptide sequence as set forth in Table 4. Gene sequences can be readily identified in other citrus species in view of known genome sequences and the conserved nature of the proteins.

In some embodiments, a citrus plant is genetically modified to introduce a recombinant expression cassette for expressing a native or heterologous BRAP2, CYP93, NDR1-like, PSL4, LYM2, SOT12, SCE1, GLY1, PAL1, WRKY70, or EFR-like polypeptide. It should be recognized that transgenic plants encompass the plant or plant cell in which the expression cassette is introduced as well as progeny of such plants or plant cells that contain the expression cassette, including the progeny that have the expression cassette stably integrated in a chromosome.

In some embodiments, the transgenic plant can have increased expression (e.g., at least 5%, 10%, 50% or more) of the BRAP2, CYP93, NDR1-like, PSL4, LYM2, SOT12, SCE1, GLY1, PAL1, WRKY70, or EFR-like polypeptide compared to a corresponding control plant that has not been genetically modified to over express the protein.

In some embodiments, a gene editing technique, such as CRISPR/Cas, can be employed to increase expression of the BRAP2, CYP93, NDR1-like, PSL4, LYM2, SOT12, SCE1, GLY1, PAL1, WRKY70, or EFR-like polypeptide, e.g., by introducing additional copies of the protein-coding sequence into the plant genome.

In some embodiments, a recombinant expression vector comprising the protein-coding sequence driven by a promoter may be introduced into the genome of the desired plant; or be introduced by CRISPR-CAS knock-in, as noted above; or be expressed by a viral vector, such as a CTV viral vector. In some embodiments, a polynucleotide encoding the polypeptide may be introduced into the plant, e.g., by recombination, such that expression is controlled by a promoter endogenous to the plant. Thus, for example, in some embodiments, the DNA construct may be introduced directly into the genomic DNA of the plant cell using techniques such as electroporation and microinjection of plant cell protoplasts, or the DNA construct can be introduced directly to plant tissue using ballistic methods, such as DNA particle bombardment. Alternatively, the DNA construct may be combined with suitable T-DNA flanking regions and introduced into a conventional *Agrobacterium tumefaciens* host vector. While transient expression of the polypeptide is encompassed by the invention, generally expression will be from insertion of expression cassettes into the plant genome, e.g., such that at least some plant offspring also contain the integrated expression cassette.

Expression Cassettes

Plant expression cassettes (e.g., for expression of a positive defense protein as described herein, or alternatively, for expression of inhibitory nucleic acids or gene editing proteins to inhibit or ablate expression of a negative immune response regulator as described herein) can contain the polynucleotide operably linked to a promoter (e.g., one conferring inducible or constitutive, environmentally- or developmentally-regulated, or cell- or tissue-specific/selective expression), a transcription initiation start site, a ribosome binding site, an RNA processing signal, a transcription termination site, and/or a polyadenylation signal.

A number of promoters can be used. A plant promoter fragment can be employed which will direct expression of the desired polynucleotide in all tissues of a plant. In some embodiments, promoters described herein comprise from 500 to 2 kb, or from 500 to 1 kb, or 500 to 2.5 kb, upstream (5') from where gene transcription is initiated. Such promoters are referred to herein as "constitutive" promoters and are active under most environmental conditions and state of development or cell differentiation. Examples of constitutive promoters include the cauliflower mosaic virus (CaMV) 35S transcription initiation region.

Alternatively, the plant promoter can direct expression of the polynucleotide under environmental control. Such promoters are referred to here as "inducible" promoters. Environmental conditions that may affect transcription by inducible promoters include biotic stress, abiotic stress, saline stress, drought stress, pathogen attack, anaerobic conditions, cold stress, heat stress, hypoxia stress, or the presence of light.

In addition, chemically inducible promoters can be used. Examples include those that are induced by benzyl sulfonamide, tetracycline, abscisic acid, dexamethasone, ethanol or cyclohexenol.

Examples of promoters under developmental control include promoters that initiate transcription only, or preferentially, in certain tissues such as leaves, roots, fruit, seeds, or flowers. These promoters are sometimes called tissue-preferred promoters. The operation of a promoter may also vary depending on its location in the genome. Thus, a developmentally regulated promoter may become fully or partially constitutive in certain locations. A developmentally regulated promoter can also be modified, if necessary, for weak expression.

Selecting for Plants with Enhanced HLB Resistance/Tolerance

Plants with enhanced HLB resistance/tolerance can be selected in many ways. One of ordinary skill in the art will recognize that the following methods are but a few of the possibilities. One of skill in the art will recognize that resistance responses of plants vary depending on many factors, including the plant. Generally, enhanced resistance is measured by the reduction or elimination of disease symptoms (e.g., reduction in the number or size of lesions or reduction in the amount of fungal biomass on the plant or a part of the plant) in response to CLas infection when compared to a control plant. In some cases, however, enhanced resistance can also be measured by the production of the hypersensitive response (HR) of the plant (see, e.g., Staskawicz et al. (1995) *Science* 268 (5211): 661-7). Plants with enhanced pathogen resistance can produce an enhanced hypersensitive response relative to control plants.

Enhanced HLB resistance can also be determined by measuring the increased expression of a gene operably linked to a positive defense regulator or decreased expression or activity of a negative immune regulator protein. Measurement of such expression can be measured by quantifying the accumulation of RNA or subsequent protein product (e.g., using northern or western blot techniques, respectively (see, e.g., Sambrook et al. and Ausubel et al.).

EXAMPLES

The following examples are provided to illustrate, but not limit the claimed invention.

This example describes the identification of positive defense regulators and negative immune response regulators. The experimental methodology used to identify and test the function of the positive and negative regulators is described by Huang et al., (2020) *Plant Biotechnol. J. doi.oprg/*10.1111/pbi.13502, which is incorporated by reference. Huang et al, describes an effective host/vector/pathogen interaction system using a close relative of CLas, *C. Liberibacter solanacearum* (CLso), which infects solanaceous plants, the potato psyllid, a major pest of potatoes and tomatoes, and *Nicotiana benthamiana*, the ideal hosts for virus-induced gene silencing (VIGS) experiments. VIGS is an effective silencing method to knock down expression of plant endogenous genes using a viral (TRV) vector. This system is very similar to the natural citrus/psyllid/CLas interaction system and can be used to rapidly characterize the function of candidate regulators in plant defense responses against *C. Liberibacter* species.

Through comparing the sRNA profiles of uninfected HLB-tolerant hybrid US-942 and uninfected HLB-sensitive mandarin Cleopatra, conserved miRNAs that were constitutively more abundant in US-942 than in the HLB-susceptible Cleopatra were discovered. Additional miRNAs that were constitutively less abundant in US-942 than in Cleopatra were also discovered. We predicted and annotated the possible immune negative and positive regulators, evaluated the expression level in US942 and Cleopatra and in another HLB-tolerant citrus relative, Sydney hybrid (*Microcitrus virgata*) with distinct genetic and geographic background. We also performed functional testing in *Nicotiana benthamiana* (Nb)/potato psyllid/*Candidatus Liberibacter solanacearum* (CLso) pathosystem described by Huang et al., 2020, supra. BRAP2, CYP93, NDR1-like, PSL4, LYM2, SOT12, SCE1, GLY1, PAL1, WRKY70, and EFR-like were identified as positive immune response regulators; and VAD1, PRT6, OPTI, YSL6, PUB26, DMR6, PAO1, TPS5, ACA11, MPKICRTI, LIN2, CRWN (LINC4), GPX8, LOX2, and PI4K were identified as negative immune response regulators.

The function of candidate regulators in defense responses against CLso was performed by TRV-based VIGS to knock down the Nb orthologous/homologous genes listed in Table 1 and 2 in Nb plants infected with CLso. The two-week-old Nb plants were exposed to CLso positive potato psyllid nymphs for 5 days. Three to four days after psyllid nymph removal, *Agrobacterium tumefaciens* carrying the TRV vector contained in a 200 to 300 bp gene fragment to silence the targeted gene was used to inoculate Nb leaves by infiltration. After 17 days of infiltration, the yellowing symptoms and vascular tissue greening of the plants were observed and compared to siRB control. The plant leaf tissue was collected for CLso DNA detection and target gene expression was analyzed by quantitative real-time polymerase chain reaction. A TRV construct containing a piece of *Solanum bulbocastanum*-specific late-blight resistance gene RB was used as a negative control (siRB). Nb does not have an orthologous gene and thus does not contain a target RB gene.

Figure 1B:
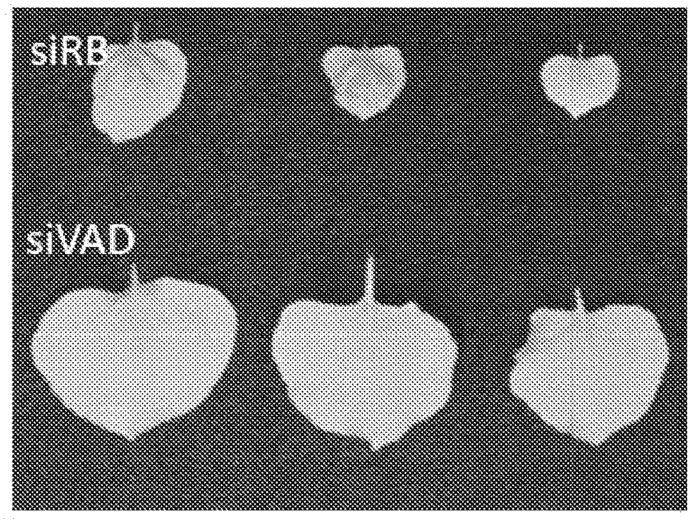
Figure 1C:
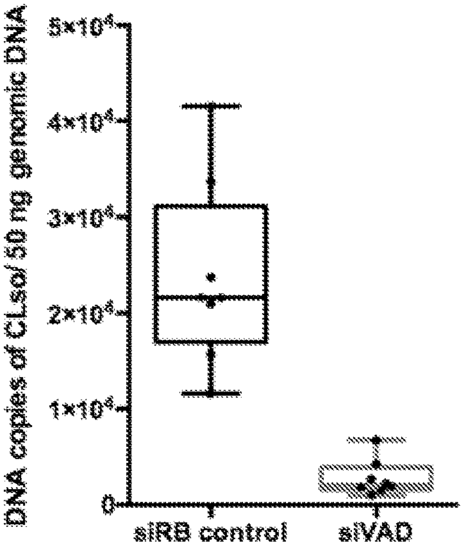
Figure 2A:
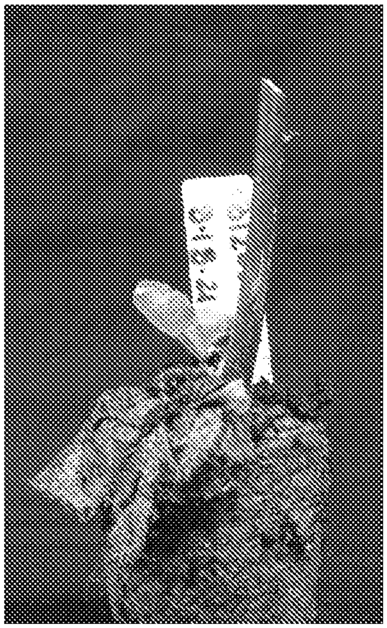
FIG. 2*a-d*: VAD knock-down Carrizo plants showed higher expression of defense marker genes including pathogenesis-related PR-2 and Chitinase (CHI). a. One cutting plant from VAD knock-down Carrizo plant. The VAD is knock down by RNA silencing. The Carrizo plant was introduced VAD harpin RNA expression vector pHellsgate8. b. The expression level of VAD in VAD silencing Carrizo plant was analyzed by qRT-PCR and normalized to Ubiqutin gene (CsUbi). The significant difference is analyzed by T test (*P<0.01). c and d. The expression level of defense marker genes, PR2 (c) and CHI (d) in VAD silencing Carrizo plant was analyzed by qRT-PCR and normalized to Ubiqutin gene (CsUbi). The significant difference is analyzed by T test (*P<0.01).
Figure 2B:
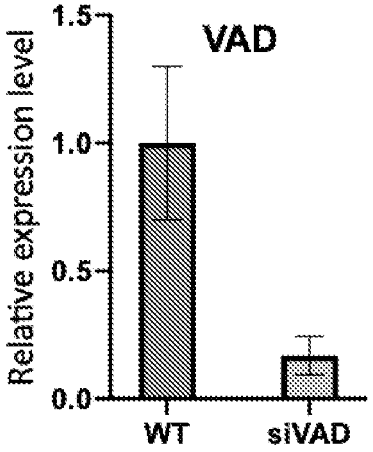
Figure 2C:
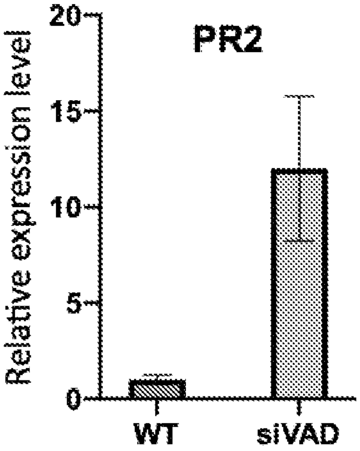
Figure 2D:
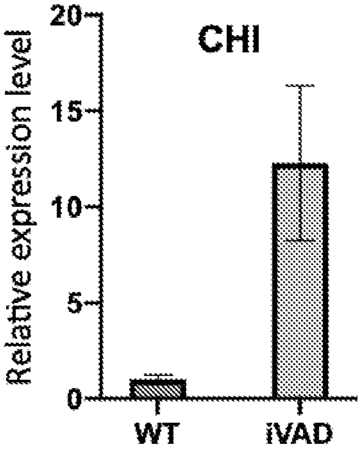

FIG. 1*a-c* provide data illustrating that mutant plants with VIGS-knocked down VAD expression displayed decreased CLso bacteria titers, measured by probe-based qPCR in 50 ng of host genomic DNA, compared to control plants in which the RB gene was silenced.

FIG. 2*a-d* provide data illustrating that VAD knocked-down Carrizo plants (knock down by RNA silencing) exhibited higher expression of defense marker genes including pathogeneis-related (PR-2) and Chitinase (CHI).

Figure 3A:
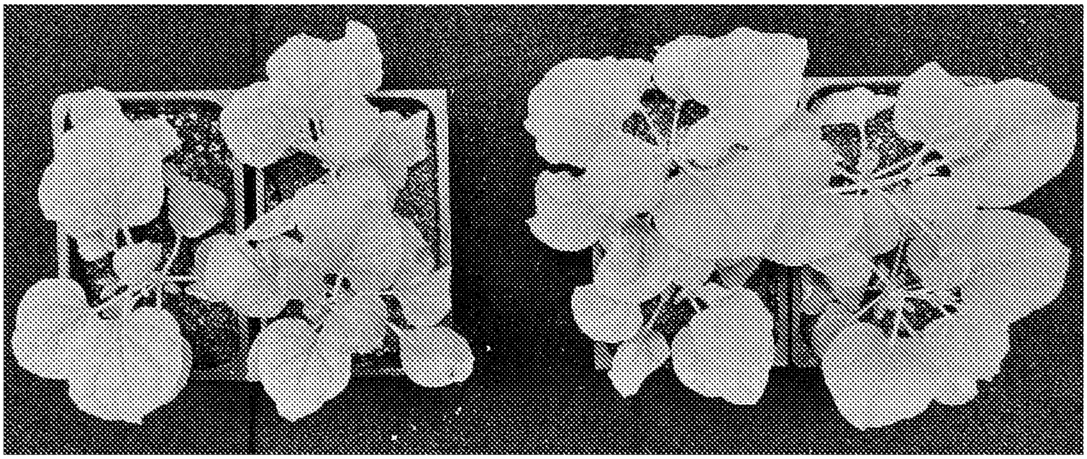
FIG. 3*a-c*: Nb/pysllid/CLso pathosystem combined with VIGS showed that PAO1 is a negative regulator in response to CLso infection. a) Two-week-old Nb plants were exposed to CLso positive potato psyllids for 5 days and PAO1 expression was knocked down by VIGS. Silencing RB gene (iRB control) was used as a control in non-silenced plants. b) Details of leaves from panel a. c) CLso bacteria titer measured by probe-based qPCR in 50 ng host genomic DNA. The significant difference is analyzed by student's t-test (*P<0.05).
Figure 3B:
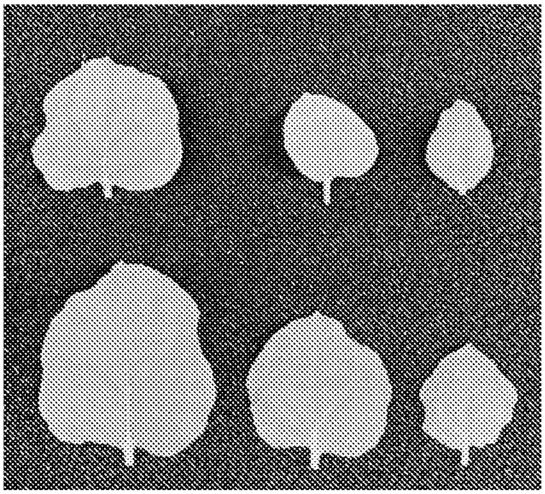
Figure 3C:
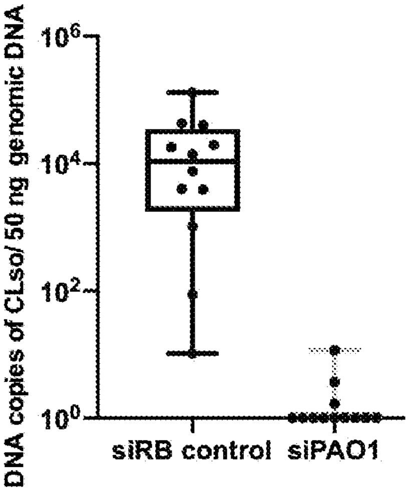

FIG. 3*a-c* provide data illustrating that PAO1 is a negative regulator in response to CLso infection. PAO1 is a polyamine oxidase that regulates reactive oxygen species homeostasis. Mutant plants with VIGS-knocked down PAO1 expression displayed decreased CLso bacteria titers, measured by probe-based qPCR in 50 ng of host genomic DNA, compared to control plants in which the RB gene was silenced.

Figure 4A:
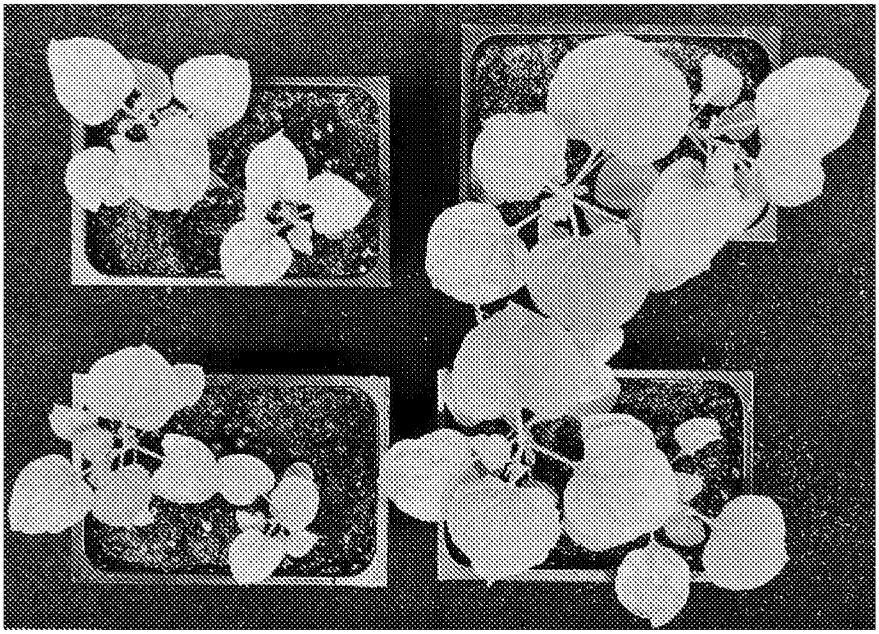
FIG. 4*a-c*: Nb/pysllid/CLso pathosystem combined with VIGS showed that CRWN is a negative regulator in response to CLso infection. a) Two-week-old Nb plants were exposed to CLso positive potato psyllids for 5 days and CRWN expression was knocked down by VIGS. Silencing RB gene (iRB control) was used as a control in non-silenced plants. b) Details of leaves from panel a. c) CLso bacteria titer measured by probe-based qPCR in 50 ng host genomic DNA. The significant difference is analyzed by student's t-test (*P<0.05).
Figure 4B:
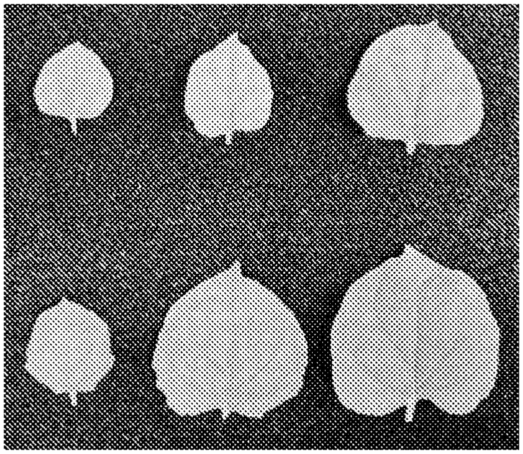
Figure 4C:
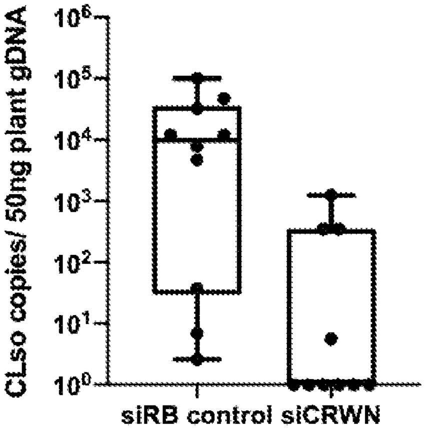

FIG. 4*a-c* provide data illustrating that CRWN is a negative regulator in response to CLso infection. CRWN is a nuclear lamina protein. Loss of CRWN protein induces the expression of the salicylic acid biosynthetic gene. Mutant plants with VIGS-knocked down CRWN expression displayed decreased CLso bacteria titers, measured by probe-based qPCR in 50 ng of host genomic DNA, compared to control plants in which the RB gene was silenced.

Figure 5A:
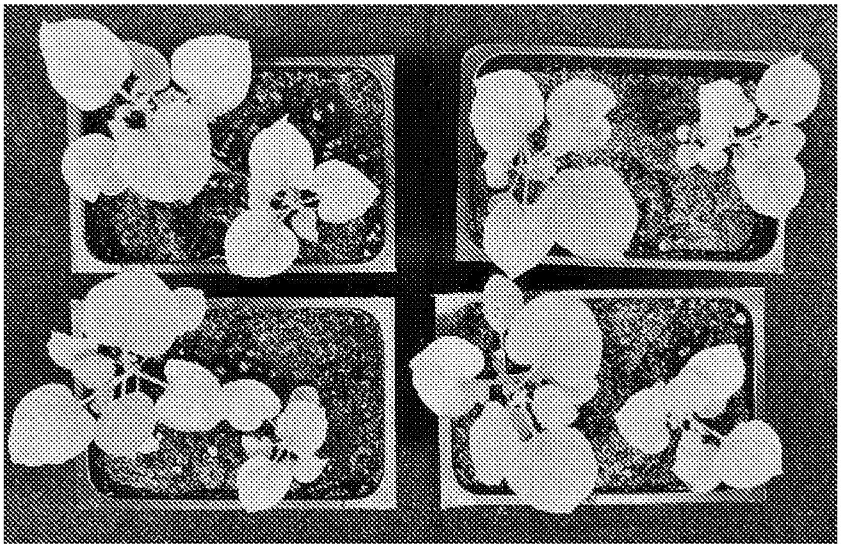
FIG. 5*a-c*: Nb/pysllid/CLso pathosystem combined with VIGS showed that GPX8 is a negative regulator in response to CLso infection. a) Two-week-old Nb plants were exposed to CLso positive potato psyllids for 5 days and GPX8 expression was knocked down by VIGS. Silencing RB gene (iRB control) was used as a control in non-silenced plants. b) Details of leaves from panel a. c) CLso bacteria titer measured by probe-based qPCR in 50 ng host genomic DNA. The significant difference is analyzed by student's t-test (*P<0.05).
Figure 5B:
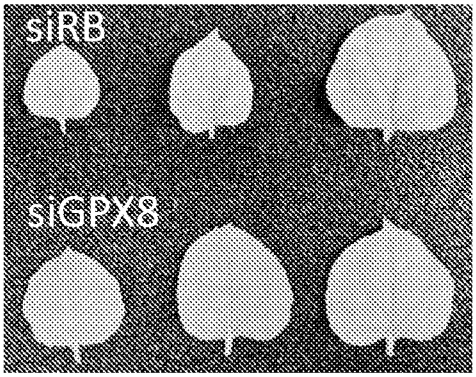
Figure 5C:
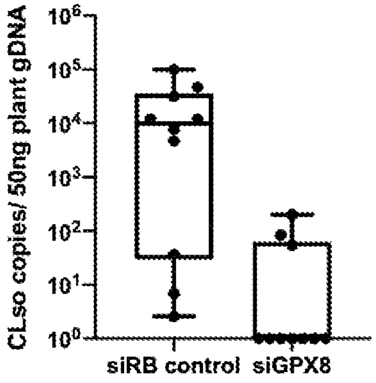

FIG. 5*a-c* provide data illustrating that GPX8 is a negative regulator in response to Clso infection. GPX8 is a glutathione peroxidase. Reduced GPX expression leads to compromised photoxidative stree tolerance, but increased resistance to virulent bacteria (see, e.g., Chang, et al., *Plant Physiol.* 150:670-683, 2009). Mutant plants with VIGS-knocked down GPX8 expression displayed decreased CLso bacteria titers, measured by probe-based qPCR in 50 ng of host genomic DNA, compared to control plants in which the RB gene was silenced.

Figure 6A:
FIG. 6*a-b*: Nb/pysllid/CLso pathosystem combined with VIGS showed that PRT6 is a negative regulator in response to CLso infection. a) Two-week-old Nb plants were exposed to CLso positive potato psyllids for 5 days and PRT6 expression was knocked down by VIGS. Silencing RB gene (iRB control) was used as a control in non-silenced plants. b) CLso bacteria titer measured by probe-based qPCR in 50 ng host genomic DNA.
Figure 6B:
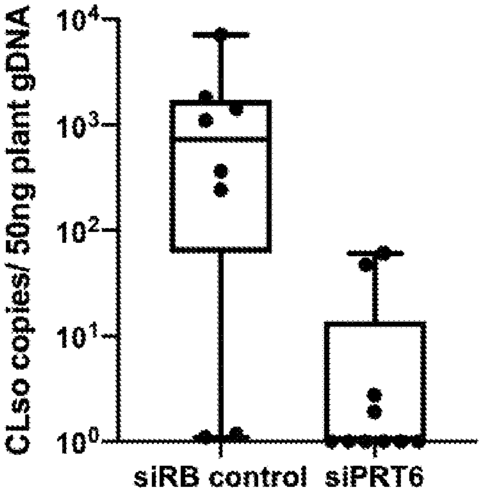

FIG. 6*a-b* provide data illustrating that PRT6 is a negative regulator in repones to CLso infection. PRT6 is an E3 ubiquitin-protein ligase. *Arabidopsis* and barley prt6 mutant plants are resistant to Pst and *Ps. japonica* and *Blumeria graminis* f. sp. *hordei* (see, e.g., Christopher et al., Plant direct 3:12 e00194, 2019). Mutant plants with VIGS-knocked down PRT6 expression displayed decreased CLso bacteria titers, measured by probe-based qPCR in 50 ng of host genomic DNA, compared to control plants in which the RB gene was silenced.

Figure 7A:
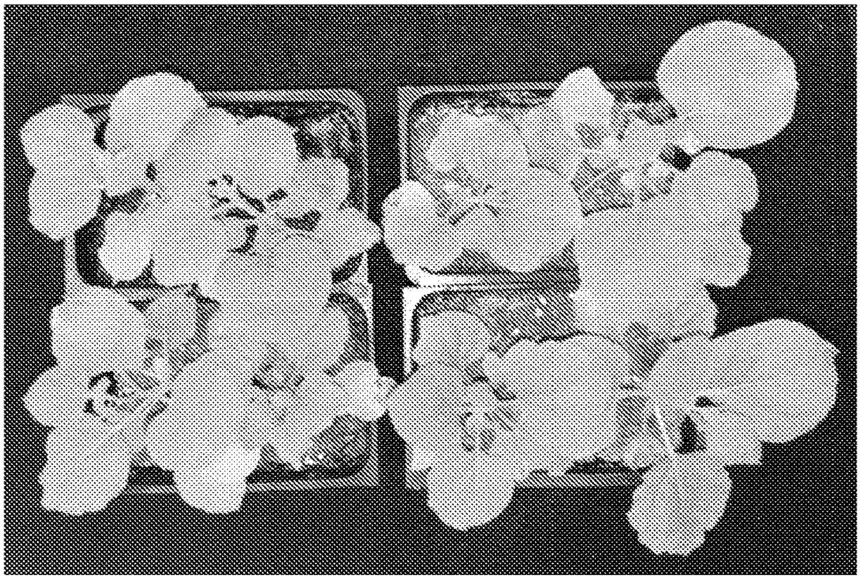
FIG. 7*a-c*: Nb/pysllid/CLso pathosystem combined with VIGS showed that PUB26 is a negative regulator in response to CLso infection. a) Two-week-old Nb plants were exposed to CLso positive potato psyllids for 5 days and PUB26 expression was knocked down by VIGS. Silencing RB gene (iRB control) was used as a control in non-silenced plants. b) Details of leaves from panel a. c) CLso bacteria titer measured by probe-based qPCR in 50 ng host genomic DNA.
Figure 7B:
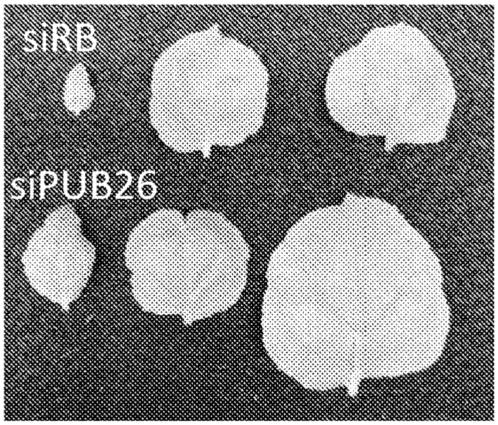
Figure 7C:
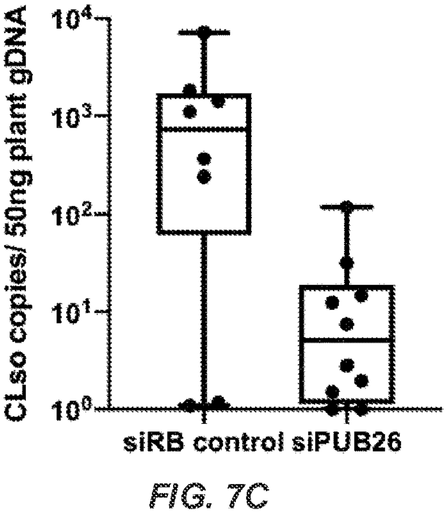

FIG. 7*a-b* provide data illustrating that PUB25/26 is a negative regulator in response to CLso infection. PUB25/26 is an E3 ligase that targets non-activated immune kinase BIK1 for degradation. Mutant plants with VIGS-knocked down PUB25/26 expression displayed decreased CLso bacteria titers, measured by probe-based qPCR in 50 ng of host genomic DNA, compared to control plants in which the RB gene was silenced.

Figure 8A:
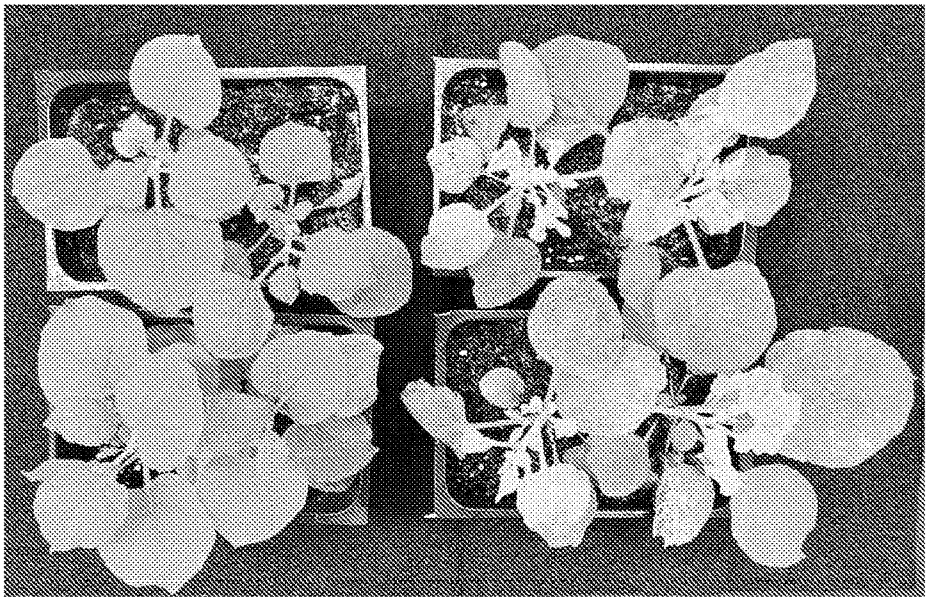
FIG. 8*a-c*: Nb/pysllid/CLso pathosystem combined with VIGS showed that LIN2 is a negative regulator in response to CLso infection. a) Two-week-old Nb plants were exposed to CLso positive potato psyllids for 5 days and LIN2 expression was knocked down by VIGS. Silencing RB gene (iRB control) was used as a control in non-silenced plants. b) Details of leaves from panel a. c) CLso bacteria titer measured by probe-based qPCR in 50 ng host genomic DNA. The significant difference is analyzed by student's t-test (*P<0.05).
Figure 8B:
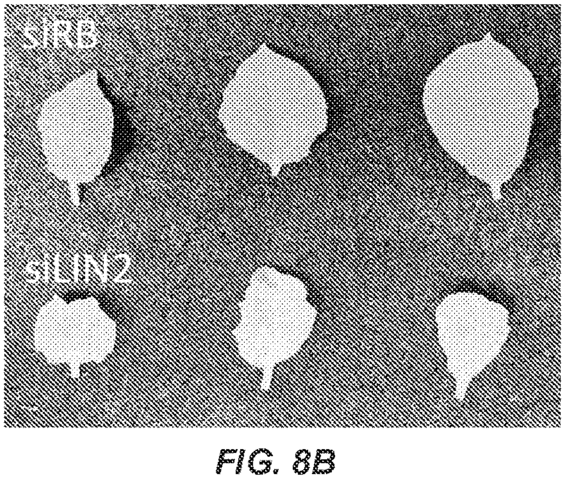
Figure 8C:
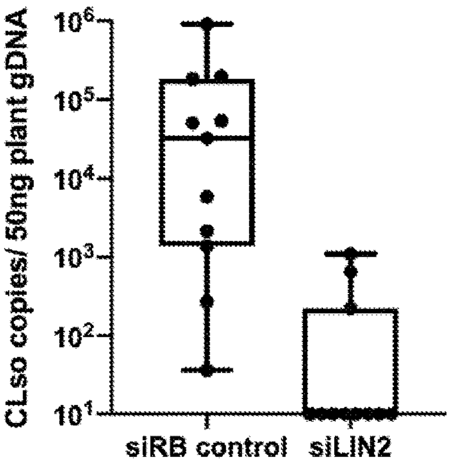

FIG. 8*a-c* provide data illustrating that LIN2 is a negative regulator in repones to CLso infection. LIN2 encodes a coproporphyrinogen III oxidase, which is a key enzyme in the biosynthetic pathway of chlorophyll and heme, a tetrapyrrole pathway. LIN2 mutants have higher expression of molecular markers associated with defense responses (see, e.g., Guo, et al., *Plant Cell Rep* 32:687-702, 2013). Mutant plants with VIGS-knocked down LIN2 expression displayed decreased CLso bacteria titers, measured by probe-based qPCR in 50 ng of host genomic DNA, compared to control plants in which the RB gene was silenced.

Positive regulators identified in the screen described above were also analyzed as immune response regulators.

Figure 9A:
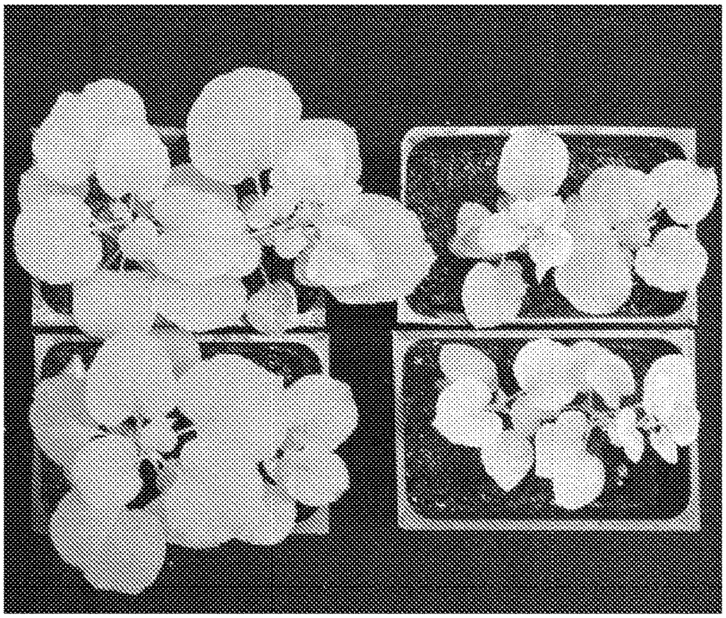
FIG. 9*a-c*: Nb/pysllid/CLso pathosystem combined with VIGS showed that BRAP is a positive regulator in response to CLso infection. a) Two-week-old Nb plants were exposed to CLso positive potato psyllids for 5 days and BRAP expression was knocked down by VIGS. Silencing RB gene (iRB control) was used as a control in non-silenced plants. b) Details of leaves from panel a. c) CLso bacteria titer measured by probe-based qPCR in 50 ng host genomic DNA. The significant difference is analyzed by student's t-test (*P<0.05).
Figure 9B:
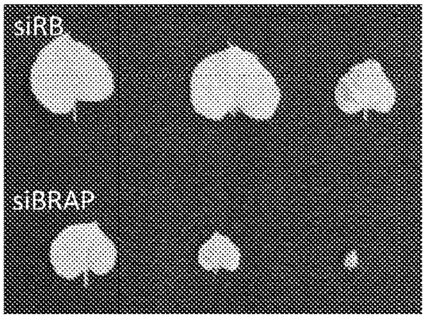
Figure 9C:
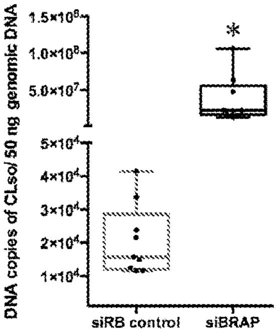

FIG. 9*a-c* provide data illustrating that BRAP is a positive regulator in response to CLso infection. BRAP is an E3-ligase that positively regulates pathogen-associated molecular patterns triggered in defense responses in plants (see, e.g., Xie, et al., *PLOS Pathog* 12:1005529, 2016). Mutant plants with VIGS-knocked down BRAP expression displayed increased CLso bacteria titers, measured by probe-based qPCR in 50 ng of host genomic DNA, compared to control plants in which the RB gene was silenced.

Figure 10A:
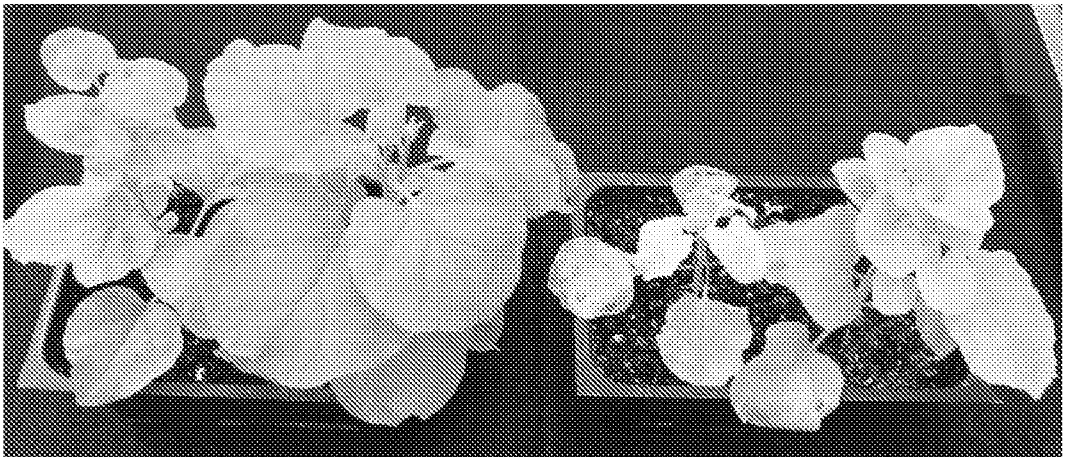
FIG. 10*a-b*: Nb/pysllid/CLso pathosystem combined with VIGS showed that PSL4 is a positive regulator in response to CLso infection. a) Two-week-old Nb plants were exposed to CLso positive potato psyllids for 5 days and PSL4 expression was knocked down by VIGS. Silencing RB gene (iRB control) was used as a control in non-silenced plants. b) CLso bacteria titer measured by probe-based qPCR in 50 ng host genomic DNA.
Figure 10B:
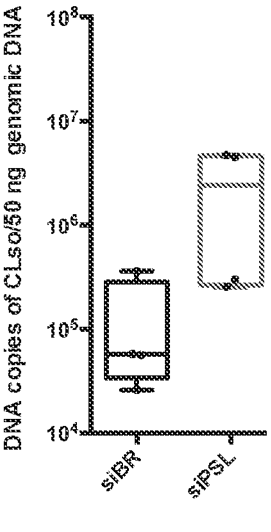

FIG. 10*a-b* provide data illustrating that PSL4 is a positive regulator in response to CLso infection. PSL4 is essential for stable accumulation and quality control of the elf18 receptor EFR. Mutant plants with VIGS-knocked down PSL4 expression displayed increased CLso bacteria titers, measured by probe-based qPCR in 50 ng of host genomic DNA, compared to control plants in which the RB gene was silenced.

Figure 11A:
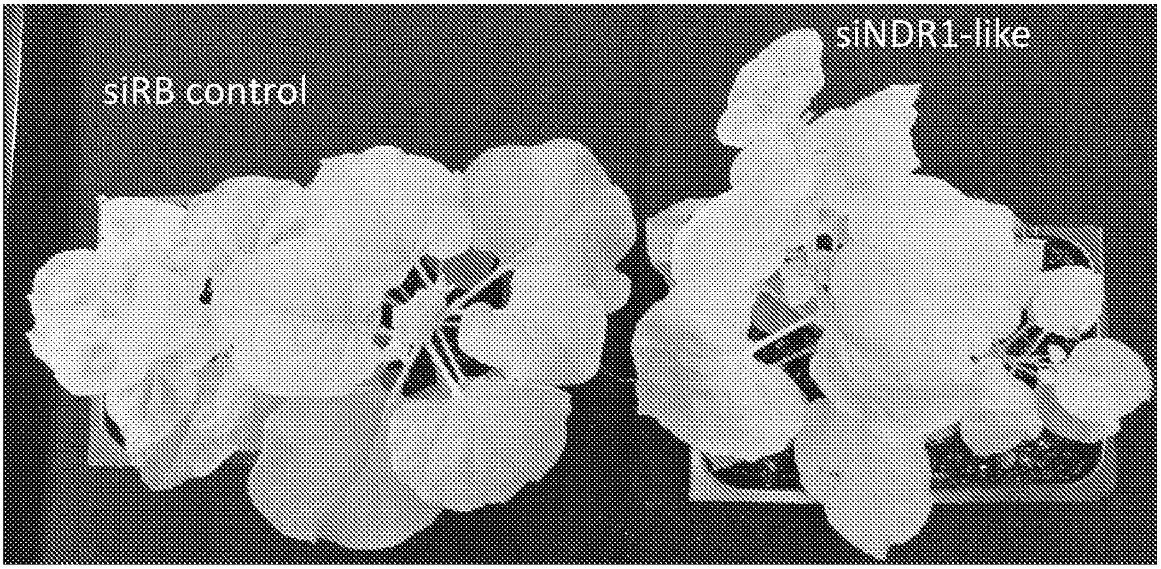
FIG. 11*a-b*: Nb/pysllid/CLso pathosystem combined with VIGS showed that NDR1-like is a positive regulator in response to CLso infection. a) Two-week-old Nb plants were exposed to CLso positive potato psyllids for 5 days and PSL4 expression was knocked down by VIGS. Silencing RB gene (iRB control) was used as a control in non-silenced plants. b) CLso bacteria titer measured by probe-based qPCR in 50 ng host genomic DNA. The significant difference is analyzed by student's t-test (*P<0.05).
Figure 11B:
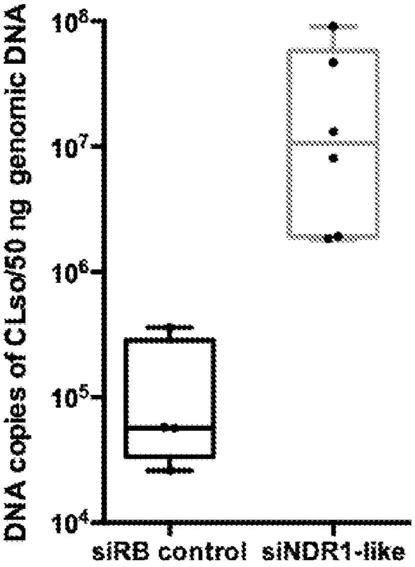

FIG. 11*a-b* provide data illustrating that NDR1-like is a positive regulator in response to CLso infection. NDR1-like (NON RACE-SPECIFIC DISEASE RESISTANCE 1) is required for non-race specific resistance to bacterial and fungal pathogens. It mediates systemic acquired resistance responses (see, e.g., Day et al., Plant Cell. 18:2782-91, 2006). Mutant plants with VIGS-knocked down NDR1-like expression displayed increased CLso bacteria titers, measured by probe-based qPCR in 50 ng of host genomic DNA, compared to control plants in which the RB gene was silenced.

All references, publications, and accession numbers are incorporated by reference as if each individual accession number were specifically and individually indicated to be incorporated by reference. Although the foregoing disclosure has been described in some detail by way of illustration and example for purposes of clarity of understanding, it will be readily apparent to those of ordinary skill in the art in light of the teachings of this disclosure that certain changes and modifications can be made thereto without departing from the spirit or scope of the invention.

TABLE 3

| Polypeptide sequence of citrus plant negative immune response regulators |
|---|
| VAD1 protein sequences |
| > CcVAD1_Ciclev10019258m_*Citrus_clementina*<br>MALVSASTERINLCGPTDPSSSRSTSEATSSANVSCAADPPDRNVQFSTS<br>PIPNGDVEVQSSVTLRSEEYRQLFRLPSEEVLVQDFNCAFQESILLQGHM<br>YLFVHFICFYSNIFGFETKKIIPFYEVTAVRRAKTAGIFPNAIEIFAAGK<br>KYFFASFLSRDEAFKLITDGWLQHGSGSLASAEQQDSSSETSSPQNGPVV<br>IEKVNCCSADPIAKSDSIIREEDLSSDSKLPANVEMTPVEMQDDNVEQDF<br>EPVLDTDSLHPIKTSSWNIENSDAPKIPECYTKVAETNFQMKVEDFYSLF<br>FSDDTVNFIESFHRKCGDKEFKCTSWHRHYEFGYSRDLSFQHPIKVYFGA<br>KFGSCKETQKFRVYRNSHLVIETSQEVHDVPYGDYFRVEGLWDVMRDDGG<br>SKEGCILRVYVNVAFSKKTVWKGKIVQSTLEECRDVYAMWIGMAHDVLKQ<br>KNLEKPEEGGPAYSTVQNDDVHSERVVNTGETSERLCNADHRIRTLPITD<br>SLDASQSVGNLLQGNLVDSAAIASLLRESMTKCCSFVKRQSGVSLILVIA<br>FAVIFLMQVSILVLLNRPQHVHMASPPDYMGAGVGVGLGQRSAESIPWLE<br>RRMHYLKDEMLMVEARLERMWHEHAVLRAQLKDIEQLHKRE- (SEQ ID NO: 1) |
| >CsVAD1.1_orange1.1g006549m_*Citrus_sinesis*<br>MALVSASTERINLCGPTDPSSSRSTSEATSSANVSCAADPPDRNVQFSTS<br>PIPNGDVEVQSSVTLRSEEYRQLFRLPSEEVLVQDENCAFQESILLQGHM<br>YLFVHFICFYSNIFGFETKKIIPFYEVTAVRRAKTAGIFPNAIEIFAAGK<br>KYFFASFLSRDEAFKLITDGWLQHGSGSLASAEQQDSSSETSSPQNGPVV<br>IEKVNCCSADPIAKSDSIIREEDLSSDSKLPANVEMTPVEMQDDNVEQDF<br>EPVLDTDSLHPIKTSSWNIENSDAPKIPECYTKVAETNFQMKVEDFYSLF<br>FSDDTVNFIESFHRKCGDKEFKCTSWHRHYEFGYSRDLSFQHPIKVYFGA<br>KFGSCKETQKERVYRNSHLVIETSQEVHDVPYGDYFRVEGLWDVMRDDGG<br>SKEGCILRVYVNVAFSKKTVWKGKIVQSTLEECRDVYAMWIGMAHDVLKQ<br>KNLEKPEEGGPAYSTVQNDDVHSERVVNTGETSERLCNADHRIRTLPITD<br>SLDASQSVGNLLQGNLVDSAAIASLLRESMTKCCSFVKRQSGVSLILVIA<br>FAVIFLMQVSILVLLNRPQHVHMASPPDYMGAGVGVGLGQRSAESIPWLE<br>RRMHYLKDEMLMVEARLERMWHEHAVLRAQLKDIEQLHKRE (SEQ ID NO: 2) |
| >CsVAD1.2_orange1.1g006377m_*Citrus_sinesis*<br>MALVSASTERINLCGPTDPSSSRSTSEATSSANVSCAADPPDRNVQFSTS<br>PIPNGDVEVQSSVTLRSEEYRQLFRLPSEEVLVQDFNCAFQESILLQGHM<br>YLFVHFICFYSNIFGFETKKIIPFYEVTAVRRAKTAGIFPNAIEIFAAGK<br>KYFFASFLSRDEAFKLITDGWLQHGSGSLASAEQQDSSSETSSPQNGPVV<br>IEKVNCCSADPIAKSDSIIREEDLSSDSKLPANVEMTPVEMQDDNVEQDF<br>EPVLDTDSLHPIKTSSWNIENSDAPKIPECYTKVAETNFQMKVEDFYSLF<br>FSDDTVNFIESFHRKCGDKEFKCTSWHRHYEFGYSRDLSFQHPIKVYFGA |

TABLE 3-continued

| Polypeptide sequence of citrus plant negative immune response regulators |
|---|
| KFGSCKETQKFRVYRNSHLVIETSQEVHDVPYGDYFRVEGLWDVMRDDGG |
| SKEGCILRVYVNVAFSKKTVWKGKIVQSTLEECRDVYAMWIGMAHDVLKQ |
| KNLEKPEGWIVVDSEGGPAYSTVQNDDVHSERVVNTGETSERLCNADHRI |
| RTLPITDSLDASQSVGNLLQGNLVDSAAIASLLRESMTKCCSFVKRQSGV |
| SLILVIAFAVIFLMQVSILVLLNRPQHVHMASPPDYMGAGVGVGLGQRSA |
| ESIPWLERRMHYLKDEMLMVEARLERMWHEHAVLRAQLKDIEQLHKRE (SEQ ID NO: 3) |
| |
| > CsVAD1.3_orange1.1g008222m_ *Citrus_sinesis* |
| MYLFVHFICFYSNIFGFETKVTSKFQCYVASCNSTLQYQSCFAISNEFML |
| QKIIPFYEVTAVRRAKTAGIFPNAIEIFAAGKKYFFASFLSRDEAFKLIT |
| DGWLQHGSGSLASAEQQDSSSETSSPQNGPVVIEKVNCCSADPIAKSDSI |
| IREEDLSSDSKLPANVEMTPVEMQDDNVEQDFEPVLDTDSLHPIKTSSWN |
| IENSDAPKIPECYTKVAETNFQMKVEDFYSLFFSDDTVNFIESFHRKCGD |
| KEFKCTSWHRHYEFGYSRDLSFQHPIKVYFGAKFGSCKETQKFRVYRNSH |
| LVIETSQEVHDVPYGDYFRVEGLWDVMRDDGGSKEGCILRVYVNVAFSKK |
| TVWKGKIVQSTLEECRDVYAMWIGMAHDVLKQKNLEKPEEGGPAYSTVQN |
| DDVHSERVVNTGETSERLCNADHRIRTLPITDSLDASQSVGNLLQGNLVD |
| SAAIASLLRESMTKCCSFVKRQSGVSLILVIAFAVIFLMQVSILVLLNRP |
| QHVHMASPPDYMGAGVGVGLGQRSAESIPWLERRMHYLKDEMLMVEARLE |
| RMWHEHAVLRAQLKDIEQLHKRE (SEQ ID NO: 4) |
| |
| >Cs_VAD1.4_orange1.1g013482m_*Citrus_sinesis* |
| MALVSASTERINLCGPTDPSSSRSTSEATSSANVSCAADPPDRNVQFSTS |
| PIPNGDVEVQSSVTLRSEEYRQLFRLPSEEVLVQDENCAFQESILLQGHM |
| YLFVHFICFYSNIFGFETKKIIPFYEVTAVRRAKTAGIFPNAIEIFAAGK |
| KYFFASFLSRDEAFKLITDGWLQHGSGSLASAEQQDSSSETSSPQNGPVV |
| IEKVNCCSADPIAKSDSIIREEDLSSDSKLPANVEMTPVEMQDDNVEQDF |
| EPVLDTDSLHPIKTSSWNIENSDAPKIPECYTKVAETNFQMKVEDFYSLF |
| FSDDTVNFIESFHRKCGDKEFKCTSWHRHYEFGYSRDLSFQHPIKVYFGA |
| KFGSCKETQKFRVYRNSHLVIETSQEVHDVPYGDYFRVEGLWDVMRDDGG |
| SKEGCILRVYVNVAFSKKTVWKGLPLLIHLLISPTCRVLLHV (SEQ ID NO: 5) |
| |
| >AbVAD1_sb18769_*Atalantia_buxifolia* |
| MSSATLRSEEYRQLFRLPSEEVLVQDFNCAFQESILLQGHMYLFVHFICF |
| YSNIFGFETKKIIPFCEVTAVRRAKTAGIFPNAIEIFAAGKKYFFASFLS |
| RDEAFKLITDGWLQHGSGSLASAEQQDSSSETSSPQNGPVVMEKVNCCSA |
| DPIAESDSIIREEDLSSDSKLPANVEMTPVEIQDDNVEQDFEPILDTDSS |
| HPIKTSSWNIENSDAPKIPECYTKVAETKFQMKVEDFYSLFFSDDTVNFI |
| ESFHRKCGDKEFKCTLWHPHDEFGYSRDLSFQHPIKVYFGAKFGSCKETQ |
| KFRVYRNSHLVIETSQEVHDVPYGDYFHVEGLWDVMRDDGGSKEGCILRV |
| YVNVAFSKKTVWKGKIVQSTVEECRDVYAIWIGMAHDVLKQKNLEKPEGW |
| IVVDSEGGPACSTVQNDDVHSERVVNTGETSERLCNADHQIRTLPITDSL |
| DASQSIGNLLQGNLVDSAAIASLLRESMTKCCSFVKRQSGVSLILVIAFA |
| VIFLMQVSILVLLNRPQHVHMASPPDYMGAGVGVGVGQRSAESIPWLERR |
| MHYLKDEMLMVEARLERMWHEHAVLRAQLKDIEQLHKRE- (SEQ ID NO: 6) |
| |
| >CiVAD1_Ci003490_ *Citrus_ichangensis* |
| MALVSASTERINLCGPTDPSSSRSTSEATSSANVSCAADPPDRNVQFSTS |
| PIPNGDVEVQSSVALRSEEYRQLFRLPSEEVLVQDFNCAFQESILLQGHM |
| YLFVHFICFYSNIFGFETKKIIPFYEVTAVRRAKTAGIFPNAIEIFAAGK |
| KYFFASFLSRDEAFKLITDGWLQHGGGSLASAEQQDSSSETSSPQNGPVV |
| IEKVNCCSADPIAESDSIIREEDLSSDSKLPANVEMTPVEMQDDNVEQDF |
| EPVLDTDSSHPIKILSWNIENSDAPKIPECYTKVAETKFQMKVEDFYSLF |
| FSDDTVNFIESFHRKCGDKEFKCTSWHQHDEFGYSRDLSFQHPIKVYFGA |
| KFGSCKETQKFQVYRNSHLVIETSQEVHDVPYGDYFRVEGLWDVMRDDGG |
| SKEGCILRVYVNVAFSKKTVWKGKIVQSTLEECRDVYAMWIGMAHDVLKQ |
| KNLEKPEEGGPACSTVQNDDVHSERLVNTGETSERLCNADHRIRTLPITD |
| SLDASQSVGNLLQGNLVDSAAIASWLRESMTKCCSFVKRQSGVSLILVIA |
| FAVIFLMQVSILVLLNRPQHVHMASPPDYMDAGVGLGLGQRSAESIPWLE |
| RRMHYLKDEMLMVEARLERMWHEHAVLRAQLKDMEQLHKRE- (SEQ ID NO: 7) |
| |
| >CuVAD1.1_GAY41820.1_*Citrus_unshiu* |
| MALVSASTERINLCGPTDPSSSRSTSEATSSANVSCAADPPDRNVQFSTSPIPNGDVEVQSSVTLRSEEYRQLFRLPSEE |
| VLVQDFNCAFQESILLQGHMYLFVHFICFYSNIFGFETKKIIPFYEVTAVRRAKTAGIFPNAIEIFAAGKKYFFASFLSR |
| DEAFKLITDGWLQHGSGSLASAEQQDSSSETSSPQNGPVVIEKVNCCSADPIAKSDSIIREEDLSSDSKLPANVEMTPVE |
| MQDDNVEQDFEPVLDTDSLHPIKTSSWNIENSDAPKIPECYTKVAETNFQMKVEDFYSLFFSDDTVNFIESFHRKCGDKG |
| AKFGSCKETQKFRVYRNSHLVIETSQEVHDVPYGDYFRVEGLWDVMRDDGGSKEGCILRVYVNVAFSKKTVWKGKIVQST |
| LEECRDVYAMWIGMAHDVLKQKNLEKPEEGGPAYSTVQNDDVHSERVVNTGETSERLCNADHRIRTLPITDSLDASQSVG |
| NLLQGNLVDSAAIASLLRESMTKCCSFVKRQSGVSLILVIAFAVIFLMQVSILVLLNRPQHVHMASPPDYMGAGVGVGLG |
| QRSAESIPWLERRMHYLKDEMLMVEARLERMWHEHAVLRAQLKDIEQLHKRE (SEQ ID NO: 8) |
| |
| >CuVAD1.2_GAY41819.1_*Citrus_unshiu* |
| MALVSASTERINLCGPTDPSSSRSTSEATSSANVSCAADPPDRNVQFSTSPIPNGDVEVQSSVTLRSEEYRQLFRLPSEE |
| VLVQDENCAFQESILLQGHMYLFVHFICFYSNIFGFETKKIIPFYEVTAVRRAKTAGIFPNAIEIFAAGKKYFFASFLSR |
| DEAFKLITDGWLQHGSGSLASAEQQDSSSETSSPQNGPVVIEKVNCCSADPIAKSDSIIREEDLSSDSKLPANVEMTPVE |
| MQDDNVEQDFEPVLDTDSLHPIKTSSWNIENSDAPKIPECYTKVAETNFQMKVEDFYSLFFSDDTVNFIESFHRKCGDKG |
| AKFGSCKETQKFRVYRNSHLVIETSQEVHDVPYGDYFRVEGLWDVMRDDGGSKEGCILRVYVNVAFSKKTVWKGKIVQST |
| LEECRDVYAMWIGMAHDVLKQKNLEKPEGWIVVDSEGGPAYSTVQNDDVHSERVVNTGETSERLCNADHRIRTLPITDSL |

TABLE 3-continued

Polypeptide sequence of citrus plant negative immune response regulators

DASQSVGNLLQGNLVDSAAIASLLRESMTKCCSFVKRQSGVSLILVIAFAVIFLMQVSILVLLNRPQHVHMASPPDYMGA
GVGVGLGQRSAESIPWLERRMHYLKDEMLMVEARLERMWHEHAVLRAQLKDIEQLHKRE (SEQ ID NO: 9)

>PtVAD1.1_Ptrif.0003s4973.2_*Poncirus_trifoliata*
MALVSASTERINLCGPTDPSSSRSTSEATPSANVSCAADPPDRNVQFSTS
PIPNGDVEVQSSVTLRSEEYRQLFRLPSEEVLVQDENCAFQESILLQGHM
YLFVHFICFYSNIFGFETKKIIPFCEVTAVRRAKTAGIFPNAIEIFAAGK
KYFFASFLSRDEAFKLITDGWLQHGGGSLASAEQQDSSSETSSPQNGPVV
IEKVNCCSADPIAESDSIIREEDLSSDSKLPANVEMTPVEMQDDNVEQDF
EPVLDTDSSHPINISSWNIENSDAPKIPECYTKVAETKFQMKVEDFYSLF
FSDDTVNFIESFHRKCGDKEFKCTSWHRHDEFGYSRDLSFQHPIKVYFGA
KFGSCKETQKFRVYRNSHLVIETSQEVHDVPYGDYFRVEGLWYVMRDDGG
SKEGCILRVYVNVAFSKKTVWKGKILQSTLEECRDVYAMWIGMAHDVLKQ
KNLEKPEEGGPACSTVQNDDVHSERVVNTGETSERLCDADHRIRTLPITD
SLDASQSVGNLLQGNLVDSAAIASWLRESMTKCCSFVKRQSGVSLILVIA
FAVIFLMQVSILVLLNRPQHVHMASPPDYMGAGVGVGLGQRSAESIPWLE
RRMHYLKDEMLMVEARLERMWHEHAVLRAQLKDMEQLHKRE- (SEQ ID NO: 10)

>SlVAD1_Solyc01g090230.2 Tomato Genome protein sequences (ITAG release 2.40)
MAAVVVPEKIMSPSPPPSQHMHLSPPTSRRSTDTSSGTNASPDRRSSLDLPSSSTSSPSRLSDAQNQLALKSEEYRLLFR
LPPDEVLVQDENCALQENFLLQGHMYLFVHSICFYSNLFGFETKKIIPFHEITAVRRAKAAIFPTAIEIVAGGKKYFFT
SFLSRDEAFKLIDDGWLQHNGAAKESADLEPQSDLTFLDSGIVEGADSFRQATERVECLERNEDNMVQEDSKPLVNGQFE
IVSNPSRVQDNVEEEVVIVQNTDCSPSEKSYGLKQEDSDAPRVPEGFTLVAEAKFPVTVEKFFELFISDAGVAFQESFRR
NCGDKDFKCTQWRPHEEFGHTRNLSFQHPIKIYLGPKFGGCHEFQKCRRYRNSHLVIESSQEISGVPFADYERVEAFWDV
ERDGDGPEGGCIMKVYLNLVFTKKTIFRGKIVQSTIDECRALYVKWIALARELLKQKKLEKEKADCLAANVVTSAQPKES
YEHVENIVETSKEIRSQIPPLNQQAADSSTVSLTSSCRDFMLKCSASLKSQSHVSILIVITIAVILILMQMSILVLLGRP
QHVQVISQGDSASSMYRLGETGVDILGFLDKKINHLKDEMFMVETLLGKMQQEHTLLKTQLKEFEHLRKLQKG (SEQ
ID NO: 11)

>St VAD1_XP_006347965.1 PREDICTED: protein VASCULAR ASSOCIATED DEATH 1,
chloroplastic [*Solanum tuberosum*]
MAAVVVPEKIMSPSPPPSQHMHTSPSTSRRSMDTASDTNASPDRRSSLDLPSSSTASPSRLSDAQNQLALKSEEYRLLFR
LPPDEVLVQDENCALQESFLLQGHMYLFGHSICFYSNLFGFETKKIIPFHEITAVRRAKAAIFPTAIEIVAGGKKYFFT
SFLSRDEAFKLIDDGWLQHNGAAKESADLEPQSDLNFLDSGIVEGADSFRQAKEGVECLERNEDNMVQEDSKPLVNGQFE
IVSNPSGVQDSVEEEAVIVQNTDCSSSEKSYGLKQEDSDAPRVPEGFTLVAEAKFPVKVEKFFEFFISDAGLAFQESFRR
KCGDKDFKCTQWRPHEEFGHTRNLSFQHPIKIYLGPKFGGCHEFQKCRHYRNSHLVIESSQEITGVPYADYFRVEAFWDV
ERDGDGPEGGCCMKVYLNVVFTKKTIFRGKIVQSTIDECRALYVTWIALAHDELLKQKKLEKEKADGQAAIVVTSAQPKK
IYEHVENLDETSNEIRSQIPPLNQQAADSSTVSITSLCRDFMLKCSSSLKSQSHVSILIVITIAVILILMQMSILVLLGR
PQHVQVISQGDSASSMYRLGETGVDILGFLDKKINHLKDEMFMVETLLGKMQQEHTLLKTQLKEFEHLRKLQKG (SEQ
ID NO: 12)

Proteolysis 6, PRT6 protein sequences

>PtPRT6_Ptrif.0006s0640_*Poncirus_trifoliata*
MEIDSPPDFSPPKPRDRIVRRLINIGVPEEFLDYSGIVNFAKNDKSRIPE
LVSTILPPDEEVAEVIQDAKAKNKKVSVGPNMKGRFRESMLWLQCLMFER
EPEKVLRKLSKIGQRAYRCRTCEHDPTCAICVPCFQNGNHKEHDYSIIYT
GGGCCDCGDVTAWKREGFCSRHKGAEQIQPLPEKYANSATPVLDALFIYW
ENKLSLAESVGQENPRSSDHVAERRKLANELTFAVVEMLLEFCKNSESLL
SFVSKRVISVIGLLDILVRAERFSSDVVVKNLHELLLKLLGEPIFKYEFA
KVFLSYYPVFVKDAIREHSDDTIKKYPLLSTFSVQIFTVPTLTPRLVKEM
NLLEMLLGCLREIFDSCAGDDSCIQVAKGANLYETTNRVIGDIRFVMSHA
AVSKYATHEQLNISKAWMKLLTFVQGMNPQKRETGIQIREENEYMHLPLV
LDHSIANIQPLLVDGAFSSAVAEETRYDESMYKQDIGDGDSLRHAKVGRL
SQESSVCGAMGRSSLSASTLKADDVIFDAVSDVLLPHSVTWLAHECLRAM
ENWLGVDDRSVSVNDILSPNASRISGSNFVALKKTLSKIKKGKSIFSRLA
GTSEVTASIQESGDLDNATSMGKESKITISGERGTASWRSAGFNDSQMEG
ECAAELDNLHVLSLCYWPDITYDVSSQDVSVHIPLHRLLSLIIQKALRRC
YGESAASESADTGAENPLSAVSLDFFGHILGGCHPYGESAFVMEHPLRIR
VFCAQVHAGMWRRNGDAALSSCEWYRAVRWSEQGLELDLFLLQCCAALAP
ADLYVNRIIERFGLSNYLSLNLERRSEYEPILVQEMLTLIIQILQERRFC
GLTTAESLKRELVHRLAIGDATHSQLVKSLPRDLSKFDQLQEILDAVAMY
SHPSGFNQVLLTALHLLALALDVCFQKKKSGDQSCDIGGSTPLLDFASEE
IAEGLNNDNELEAGNCNLSSVIESLLKKFAEIDSRCMTKLQQLAPEIVSH
LSQSLPRDDTSGSFSASDSEKRKAKARERQAAILEKMKAEQFKFLSSISS
NIEDAPKSAPEVTNYDAEHVSEESVQDVCALCHDPNSRTPVSYLILLQKS
RLLSFVDRGSPSWDQDQWLGKECGTISANNMVNQFGTNTPSSGLGVISSC
QLAQVAEEAVNQFAYNGKPEEVNAVLEFVKAQFPSLRNIPIPFTFSNGRK
CTASSMEMFEQDLYLSICREMRKNMTYPDLMKEDEECSVAEGGFKNRGNS
DSFLLGKYVASISKEMRENASASEVSRGDRIAAESLVYDGFGPIDCDGIH
LSSCGHAVHQGCLDRYVSSLKERQFSLRNAAASINLPAAVMCFVCLYACI
YNRRIIFEGGHIVDPDEGEFLCPVCRQLANSVLPALPWDLQRINEQPTVS
GVGLEENTSLQLQQAVSLLLSASNVVGKADVIESFPLMKNEIMASNVEAV
SRRMCKMYFQNKVDKFFGSARVNPSLIMWDALKYSLMSMEIAARSEKTSM
TPIYDVNALDKELRSSSGFVLSLLLKVVQSMRSKNSLHVLQRFRGIQLFA
ESICSGTSIDNPGGRCKRGGNMLSILKHADVEVSYPDIQFWNRASDPVLA
RDPFSSLMWVLFCLPCQFILCKESLLSLVHVFYAVTLSQAVLSCCGKLQS
KVNELGFSDSLISDISKLLGEFGSAQEYFVSNYIDPSCDIKDMIRRLSFP TABLE 3-continued

| Polypeptide sequence of citrus plant negative immune response regulators |
|---|

YLRRDHVLARSSHGISDMMDSSDDALSDLKEIQEVEKMFKIPSLDVILKD
EVLRSLVLKWFHHFSKEFEVHRFQHVLYSTPAVPFKLMRLPHLYQDLLQR
LCSPRWKPCCRESSCQSHAMACGAGTGVFLLIRRTTILLQRCARQAPWPS
PYLDAFGEEDIEMHRGKPLYLNEERYAALTYMVASHGLDRSSKVLSQTTI
GGFFLV- (SEQ ID NO: 13)

>CcPRT6_ESR42326.1_CICLE_v10013610m_*Citru_ clementina*
MEIDSPPDFSPPKPRDRIVRRLINIGVPEEFLDYSGIVNFAK
NDKSRIPELVSTILPPDEEVAEVIQDAKAKNKKVSVGPNMKGRFRESMLWLQWLMFEREPEKVLRKLSKIGQRGVCGAVW
GNNDIAYRCRTCEHDPTCAICVPCFQNGNHKEHDYSIIYTGGGCCDCGDVTAWKREGFCSRHKGAEQIQPLPEKYANSAA
PVLDALFIYWENKLSLAESVGQENPRASDHVAERRKLANELTFAVVEMLLEFCKNSESLLSFVSKRVISVIGLLDILVRA
ERFSSDVVVRKLHELLLKLLGEPIFKYEFAKVELSYYPVFVKDAIREHSDDTIKKYPLLSTFSVQIFTVPTLTPRLVKEM
NLLEMLLGCLREIFDSCAGDDSCLQVAKWANLYETTNRVIGDIRFVMSHAAVSKYATHEQLNISKAWMKLLTFVQGMNPQ
KRETGIHIREENEYMHLPLVLDHSIANIQPLLVDGAFSSAVAEETRYDESMYKQDIGDGDSLRHAKVGRLSQESSVCGAM
GRSSLSASTLKADDVIFDAVSDVLLPHSVTWLAHECLRAMENWLGVDDRSVSVNDILSPNASRISGSNFVALKKTLSKIK
KGKSIFSRLAGSSEVTAGIQESGDLDNATSMGKESKITISGERDTASWRSAGFNDSEMEGECATELDNLHVLSLCYWPDI
TYDVSSQDVSVHIPLHRLLSLIIQKALRRCYGESAASESADTGAENPLSAVSLDFFGHILGGCHPYGFSAFVMEHPLRIR
VFCAQVHAGMWRRNGDAALSSCEWYRAVRWSEQGLELDLFLLQCCAALAPADLYVNRIIERFGLSNYLSLNLERPSEYEP
ILVQEMLTLIIQILQERRFCGLTTAESLKRELVHRLAIGDATHSQLVKSLPRDLSKFDQLQEILDAVAMYSHPSGFNQLA
ITTCKSKVVLQVIRAVLFYAVFTDNPTDSRAPYGVLLTALHLLALALDVCFQKKKSGDQSCDIGGSTPILDFASEEIAEG
LNNGAGKQSLLSLLVFLMGMYKKDGADNFLEAGNCNLSSVIESLLKKFAEIDSRCMTKLQQLAPEIVSHLSQSLPRDDTS
GSFSASDSEKRKAKARERQAAILEKMKAEQFKFLSSISSNIEDAPKSAPEVTNYDAEHVSEESVQDVCALCHDPNSRTPV
SYLILLQKSRLLSFVDRGSPSWDQDQWLGKECGTISANNMVNQFGTNTPSSALGVISSCQLAQVAEEAVNQFAYNGKPEE
VNAVLEFVKAQFSLRNIPIPFTFSNGRKCTASSMEMFEQDLYLSICREMRKNMTYPDLMKEDEECSVAEGGLKNRGNSD
SFLLGKYVASISKEMRENASASEVSRGDRIAAESLVYDGFGPIDCDGIHLSSCGHAVHQGCLDRYVSSLKERYNRRIIFE
GGHIVDPDQGEFLCPVCRQLANSVLPALPWDLQRINEQPTVSGVGLSLDSNSSFTTREENTSLQLQQAVSLLQSASNVVG
KADVIESFPLLKNEIMASNVEAVSRRMCKMYFQNKLDKFFGSARVNPSLIMWDALKYSLMSMEIAARSEKTSTTPIYDVN
ALDKELKSSSGFVLSLLLKVVQSMRSKNSLHVLQRFRGIQLFAESICSGTSIDNPGGRCKRGGNMLSILKHADVEVSYPD
IQFWNRASDPVLARDPFSSLMWVLFCLPCQFILCKESLLSLVHVFYAVTLSQAVLSCCGKLQSKVNELGESDSLISDISK
LLGEFGSAQEYFVSNYIDPSCDIKDMIRRLSFPYLRRDHVLARSSHGISDMMDSSDDALSDLKEIQEVEKMFKIPSLDVI
LKDEVLRSLVLKWFHHFSKEFEVHRFQHVLYSTPAVPFKLMCLPHLYQDLLQRLCSPSWKPCCRESSCQSHAVACGAGTG
VFLLIRRTTILLQRCARQAPWPSPYLDAFGEEDIEMHRGKPLYLNEERYAALTYMVASHGLDRSSKVLSQTTIGGFFLV
(SEQ ID NO: 14)

>CsPRT6 isoform X1_XP_006480821.1_*Citrus_sinensis*
MEIDSPPDFSPPKPRDRIVRRLINIGVPEEFLDYSGIVNFAKNDKSRIPELVSTILPPDEEVAEVIQDAKAKNKKVSVGP
NMKGRFRESMLWLQWLMFEREPEKVLRKLSKIGQRGVCGAVWGNNDIAYRCRTCEHDPTCAICVPCFQNGNHKEHDYSII
YTGGGCCDCGDVTAWKREGFCSRHKGAEQIQPLPEKYANSAAPVLDALFIYWENKLSLAESVGQENPRASDHVAERRKLA
NELTFAVVEMLLEFCKNSESLLSFVSKRVISVIGLLDILVRAERFSSDVVVRKLHELLLKLLGEPIFKYEFAKVELSYYP
VFVKDAIREHSDDTIKKYPLLSTFSVQIFTVPTLTPRLVKEMNLLEMLLGCLREIFDSCAGDDSCLQVAKWANLYETTNR
VIGDIRFVMSHAAVSKYATHEQLNISKAWMKLLTFVQGMNPQKRETGIHIREENEYMHLPLVLDHSIANIQPLLVDGAFS
SAVAEETRYDESMYKQDIGDGDSLRHAKVGRLSQESSVCGAMGRSSLSASTLKADDVIFDAVSDVLLPHSVTWLAHECLR
AMENWLGVDDRSVSVNDILSPNASRISGSNFVALKKTLSKIKKGKSIFSRLAGSSEVTAGIQESGDLDNATSMGKESKIT
ISGERDTASWRSAGENDSEMEGECATELDNLHVLSLCYWPDITYDVSSQDVSVHIPLHRLLSLIIQKALRRCYGESAASE
SADTGAENPLSAVSLDFFGHILGGCHPYGFSAFVMEHPLRIRVFCAQVHAGMWRRNGDAALSSCEWYRAVRWSEQGLELD
LFLLQCCAALAPADLYVNRIIERFGLSNYLSLNLERPSEYEPILVQEMLTLIIQILQERRFCGLTTAESLKRELVHRLAI
GDATHSQLVKSLPRDLSKEDQLQEILDAVAMYSHPSGENQGMYSLRWSYWKELDIYHPRWSSRDLQVAEERYLRFCSVSA
LTAQLPRWTKIYYPLESIAGIATCKVVLQVIRAVLFYAVFTDNPTDSRAPYGVLLTALHLLALALDVCFQKKKSGDQSCD
IGGSTPILDFASEEIAEGLNNGAGKQSLLSLLVFLMGMYKKDGADNFLEAGNCNLSSVIESLLKKFAEIDSRCMTKLQQL
APEIVSHLSQSLPRDDTSGSFSASDSEKRKAKARERQAAILEKMKAEQFKELSSISSNIEDAPKSAPEVTNYDAEHVSEE
SVQDVCALCHDPNSRTPVSYLILLQKSRLLSFVDRGSPSWDQDQWLGKECGTISANNMVNQFGTNTPSSALGVISSCQLA
QVAEEAVNQFAYNGKPEEVNAVLEFVKAQFPSLRNIPIPFTFSNGRKCTASSMEMFEQDLYLSICREMRKNMTYPDLMKE
DEECSVAEGGLKNRGNSDSFLLGKYVASISKEMRENASASEVSRGDRIAAESLVYDGFGPIDCDGIHLSSCGHAVHQGCL
DRYVSSLKERYNRRIIFEGGHIVDPDQGEFLCPVCRQLANSVLPALPWDLQRINEQPTVSGVGLSLDSNSSFTTREENTS
LQLQQAVSLLQSASNVVGKADVIESFPLLKNEIMASNVEAVSRRMCKMYFQNKLDKFFGSARVNPSLIMWDALKYSLMSM
EIAARSEKTSTTPIYDVNALDKELKSSSGFVLSLLLKVVQSMRSKNSLHVLQRERGIQLFAESICSGTSIDNPGGRCKRG
GNMLSILKHADVEVSYPDIQFWNRASDPVLARDPFSSLMWVLFCLPCQFILCKESLLSLVHVFYAVTLSQAVLSCCGKLQ
SKVNELGFSDSLISDISKLLGEFGSAQEYFVSNYIDPSCDIKDMIRRLSFPYLRRCALLWKLLNSTVPPPFSDRDHVLAR
SSHGISDMMDSSDDALSDLKEIQEVEKMFKIPSLDVILKDEVLRSLVLKWFHHFSKEFEVHRFQHVLYSTPAVPFKLMCL
PHLYQDLLQRYIKQCCSDCKSVLDEPALCLLCGRLCSPSWKPCCRESSCQSHAVACGAGTGVFLLIRRTTILLQRCARQA
PWPSPYLDAFGEEDIEMHRGKPLYLNEERYAALTYMVASHGLDRSSKVLSQTTIGGFFLV (SEQ ID NO: 15)

>CsPRT6 isoform X2 XP_006480824.1_*Citrus_sinensis*
MEIDSPPDFSPPKPRDRIVRRLINIGVPEEFLDYSGIVNFAKNDKSRIPELVSTILPPDEEVAEVIQDAKAKNKKVSVGP
NMKGRFRESMLWLQWLMFEREPEKVLRKLSKIGQRGVCGAVWGNNDIAYRCRTCEHDPTCAICVPCFQNGNHKEHDYSII
YTGGGCCDCGDVTAWKREGFCSRHKGAEQIQPLPEKYANSAAPVLDALFIYWENKLSLAESVGQENPRASDHVAERRKLA
NELTFAVVEMLLEFCKNSESLLSFVSKRVISVIGLLDILVRAERFSSDVVVRKLHELLLKLLGEPIFKYEFAKVFLSYYP
VFVKDAIREHSDDTIKKYPLLSTFSVQIFTVPTLTPRLVKEMNLLEMLLGCLREIFDSCAGDDSCLQVAKWANLYETTNR
VIGDIRFVMSHAAVSKYATHEQLNISKAWMKLLTFVQGMNPQKRETGIHIREENEYMHLPLVLDHSIANIQPLLVDGAFS
SAVAEETRYDFSMYKQDIGDGDSLRHAKVGRLSQESSVCGAMGRSSLSASTLKADDVIFDAVSDVLLPHSVTWLAHECLR
AMENWLGVDDRSVSVNDILSPNASRISGSNFVALKKTLSKIKKGKSIFSRLAGSSEVTAGIQESGDLDNATSMGKESKIT
ISGERDTASWRSAGFNDSEMEGECATELDNLHVLSLCYWPDITYDVSSQDVSVHIPLHRLLSLIIQKALRRCYGESAASE
SADTGAENPLSAVSLDFFGHILGGCHPYGFSAFVMEHPLRIRVFCAQVHAGMWRRNGDAALSSCEWYRAVRWSEQGLELD
LFLLQCCAALAPADLYVNRIIERFGLSNYLSLNLERPSEYEPILVQEMLTLIIQILQERRFCGLTTAESLKRELVHRLAI
GDATHSQLVKSLPRDLSKFDQLQEILDAVAMYSHPSGFNQGMYSLRWSYWKELDIYHPRWSSRDLQVAEERYLRFCSVSA
LTAQLPRWTKIYYPLESIAGIATCKVVLQVIRAVLFYAVFTDNPTDSRAPYGVLLTALHLLALALDVCFQKKKSGDQSCD
IGGSTPILDFASEEIAEGLNNGAGKQSLLSLLVFLMGMYKKDGADNFLEAGNCNLSSVIESLLKKFAEIDSRCMTKLQQL
APEIVSHLSQSLPRDDTSGSFSASDSEKRKAKARERQAAILEKMKAEQFKFLSSISSNIEDAPKSAPEVTNYDAEHVSEE TABLE 3-continued

| Polypeptide sequence of citrus plant negative immune response regulators |
|---|
| SVQDVCALCHDPNSRTPVSYLILLQKSRLLSFVDRGSPSWDQDQWLGKECGTISANNMVNQFGTNTPSSALGVISSCQLA<br>QVAEEAVNQFAYNGKPEEVNAVLEFVKAQFPSLRNIPIPFTFSNGRKCTASSMEMFEQDLYLSICREMRKNMTYPDLMKE<br>DEECSVAEGGLKNRGNSDSELLGKYVASISKEMRENASASEVSRGDRIAAESLVYDGFGPIDCDGIHLSSCGHAVHQGCL<br>DRYVSSLKERYNRRIIFEGGHIVDPDQGEFLCPVCRQLANSVLPALPWDLQRINEQPTVSGVGLSLDSNSSFTTREENTS<br>LQLQQAVSLLQSASNVVGKADVIESFPLLKNEIMASNVEAVSRRMCKMYFQNKLDKFFGSARVNPSLIMWDALKYSLMSM<br>EIAARSEKTSTTPIYDVNALDKELKSSSGFVLSLLLKVVQSMRSKNSLHVLQRFRGIQLFAESICSGTSIDNPGGRCKRG<br>GNMLSILKHADVEVSYPDIQFWNRASDPVLARDPFSSLMWVLFCLPCQFILCKESLLSLVHVFYAVTLSQAVLSCCGKLQ<br>SKVNELGFSDSLISDISKLLGEFGSAQEYFVSNYIDPSCDIKDMIRRLSFPYLRRCALLWKLLNSTVPPPESDRDHVLAR<br>SSHGISDMMDSSDDALSDLKEIQEVEKMEKIPSLDVILKDEVLRSLVLKWFHHESKEFEVHRFQHVLYSTPAVPFKLMCL<br>PHLYQDLLQRYIKQCCSDCKSVLDEPALCLLCGRLCSPSWKPCCSCQSHAVACGAGTGVFLLIRRTTILLQRCARQAPWP<br>SPYLDAFGEEDIEMHRGKPLYLNEERYAALTYMVASHGLDRSSKVLSQTTIGGFFLV (SEQ ID NO: 16)<br><br>>CsPRT6.1_KDO44129.1_CISIN_1g000141mg_*Citrus_sinensis*<br>MEIDSPPDFSPPKPRDRIVRRLMNIGVPEEFLDYSGIVNFAKNDKSRIPELVSTILPPDEEVAEVIQDAKAKNKKVSVGP<br>NMKGRFRESMLWLQWLMFEREPEKVLRKLSKIGQRGVCGAVWGNNDIAYRCRTCEHDPTCAICVPCFQNGNHKEHDYSII<br>YTGGGCCDCGDVTAWKREGFCSRHKGAEQIQPLPEKYANSAAPVLDALFIYWENKLSLAESVGQENPRASDHVAERRKLA<br>NELTFAVVEMLLEFCKNSESLLSFVSKRVISVIGLLDILVRAEMFSSDVVVRKLHELLLKLLGEPIFKYEFAKVFLSYYP<br>VFVKDAIREHSDDTIKKYPLLSTFSVQIFTVPTLTPRLVKEMNLLEMLLGCLREIFDSCAGDDSCLQVAKWANLYETTNR<br>VIGDIRFVMSHAAVSKYATHEQLNISKAWMKLLTFVQGMNPQKRETGIHIREENEYMHLPLVLDHSIANIQPLLVDGAFS<br>SAVSEETRYDESMYKQDIGDGDSLRHAKVGRLSQESSVCGAMGRSSLSASTLKADDVIFDAVSDVLLPHSVTWVAHECLR<br>AMENWLGVDDRSVSVNDILSPNASRISGSNFVALKKTLSKIKKGKSIFSRLAGSSEVTAGIQESGDLDNATSMGKESKIT<br>ISGERDTASWRSAGENDSEMEGECATELDNLHVLSLCYWPDITYDVSSQDVSVHIPLHRLLSLIIQKALRRCYGESAASE<br>SADTGAENPLSAVSLDFFGHILGGCHPYGESAFVMEHPLRIRVFCAQVHAGMWRRNGDAALSSCEWYRAVRWSEQGLELD<br>LFLLQCCAALAPADLYVNRIIERFGLSNYLSLNLERPSEYEPILVQEMLTLIIQILQERRFCGLTTAESLKRELVHRLAI<br>GDATHSQLVKSLPRDLSKEDQLQEILDAVAMYSHPSGFNQGMYSLRWSYWKELDIYHPRWSSRDLQVAEERYLRFCSVSA<br>LTAQLPRWTKIYYPLESIAGIATCKVVLQVIRAVLFYAVFTDNPTDSRAPYGVLLTALHLLALALDVCFQKKKSGDQSCD<br>IGGSTPILDFASEEIAEGLNNGAGKQSLLSLLVFLMGMYKKDGADNFLEAGNCNLSSVIESLLKKFAEIDSRCMTKLQQL<br>APEIVSHLSQSLPRDDTSGSFSASDSEKRKAKARERQAAILEKMKAEQFKFLSSISSNIEDAPKSAPEVTNYDAEHVSEE<br>SVQDVCALCHDPNSRTPVSYLILLQKSRLLSFVDRGSPSWDQDQWLGKECGTISANNMVNQFGTNTPSSGLGVISSCQLA<br>QVAEEAVNQFAYNGKPEEVNSVLEFVKAQFPSLRNIPIPFTFSNGRKCTASSMEMFEQDLYLSICREMRKNMTYPDLMKE<br>DEECSVAEGGLKNRGNSDSFLLGKYVASISKEMRENASASEVSRGDRIAAESLVYDGFGPIDCDGIHLSSCGHAVHQGCL<br>DRYVSSLKERYNRRIIFEGGHIVDPDQGEFLCPVCRQLANSVLPALPWDLQRINEQPTVSGVGLSLDSSSSFTTREENTS<br>FQLQQAVSLLQSASNVVGKADVIESFPLMKNEIMASNVEAVSRRMCKMYFQNKLDKFFGSARVNPSLIMWDALKYSLMSM<br>EIAARSEKTSTTPIYDVNALDKELKSSSGFVLSLLLKVVQSMRSKNSLHVLQRFRGIQLFAESICSGTSIDNPGGRCKRG<br>GNMLSILKHADVEVSYPDIQFWNRASDPVLARDPFSSLMWVLFCLPCQFILCKESLLSLVHVFYAVTLSQAVLSCCGKLQ<br>SKVNELGESDSLISDISKLLGEFGSAQEYFVSNYIDPSCDIKDMIRRLSFPYLRRCALLWKLLNSTVPPPFSDRDHVLAR<br>SSHGISDMMDSSDDALSDLKEIQEVEKMFKIPSLDVILKDEVLRSLVLKWFHHESKEFEVHRFQHVLYSTPAVPFKLMCL<br>PHLYQDLLQRYIKQCCSDCKSVLDEPALCLLCGRLCSPSWKPCCRESSCQSHAVACGAGTGVFLLIRRTTILLQRCARQA<br>PWPSPYLDAFGEEDIEMHRGKPLYLNEERYAALTYMVASHGLDRSSKVLSQTTIGGFFLV (SEQ ID NO: 17)<br><br>> CsPRT6.2_KDO44133.1_CISIN_1g000141mg_*Citrus_sinensis*<br>MEIDSPPDFSPPKPRDRIRLMNIGVPEEFLDYSGIVNFAKNDKSRIPELVSTILPPDEEVAEVIQDAKAKNKKVSVGPNM<br>KGRFRESMLWLQWLMFEREPEKVLRKLSKIGQRGVCGAVWGNNDIAYRCRTCEHDPTCAICVPCFQNGNHKEHDYSIIYT<br>GGGCCDCGDVTAWKREGFCSRHKGAEQIQPLPEKYANSAAPVLDALFIYWENKLSLAESVGQENPRASDHVAERRKLANE<br>LTFAVVEMLLEFCKNSESLLSFVSKRVISVIGLLDILVRAEMFSSDVVVRKLHELLLKLLGEPIFKYEFAKVELSYYPVF<br>VKDAIREHSDDTIKKYPLLSTFSVQIFTVPTLTPRLVKEMNLLEMLLGCLREIFDSCAGDDSCLQVAKWANLYETTNRVI<br>GDIRFVMSHAAVSKYATHEQLNISKAWMKLLTFVQGMNPQKRETGIHIREENEYMHLPLVLDHSIANIQPLLVDGAFSSA<br>VSEETRYDFSMYKQDIGDGDSLRHAKVGRLSQESSVCGAMGRSSLSASTLKADDVIFDAVSDVLLPHSVTWVAHECLRAM<br>ENWLGVDDRSVSVNDILSPNASRISGSNFVALKKTLSKIKKGKSIFSRLAGSSEVTAGIQESGDLDNATSMGKESKITIS<br>GERDTASWRSAGFNDSEMEGECATELDNLHVLSLCYWPDITYDVSSQDVSVHIPLHRLLSLIIQKALRRCYGESAASESA<br>DTGAENPLSAVSLDFFGHILGGCHPYGFSAFVMEHPLRIRVFCAQVHAGMWRRNGDAALSSCEWYRAVRWSEQGLELDLF<br>LLQCCAALAPADLYVNRIIERFGLSNYLSLNLERPSEYEPILVQEMLTLIIQILQERRFCGLTTAESLKRELVHRLAIGD<br>ATHSQLVKSLPRDLSKFDQLQEILDAVAMYSHPSGFNQGMYSLRWSYWKELDIYHPRWSSRDLQVAEERYLRFCSVSALT<br>AQLPRWTKIYYPLESIAGIATCKVVLQVIRAVLFYAVFTDNPTDSRAPYGVLLTALHLLALALDVCFQKKKSGDQSCDIG<br>GSTPILDFASEEIAEGLNNGAGKQSLLSLLVFLMGMYKKDGADNFLEAGNCNLSSVIESLLKKFAEIDSRCMTKLQQLAP<br>EIVSHLSQSLPRDDTSGSFSASDSEKRKAKARERQAAILEKMKAEQFKELSSISSNIEDAPKSAPEVTNYDAEHVSEESV<br>QDVCALCHDPNSRTPVSYLILLQKSRLLSFVDRGSPSWDQDQWLGKECGTISANNMVNQFGTNTPSSGLGVISSCQLAQV<br>AEEAVNQFAYNGKPEEVNSVLEFVKAQFPSLRNIPIPFTFSNGRKCTASSMEMFEQDLYLSICREMRKNMTYPDLMKEDE<br>ECSVAEGGLKNRGNSDSFLLGKYVASISKEMRENASASEVSRGDRIAAESLVYDGFGPIDCDGIHLSSCGHAVHQGCLDR<br>YVSSLKERYNRRIIFEGGHIVDPDQGEFLCPVCRQLANSVLPALPWDLQRINEQPTVSGVGLSLDSSSSFTTREENTSFQ<br>LQQAVSLLQSASNVVGKADVIESFPLMKNEIMASNVEAVSRRMCKMYFQNKLDKFFGSARVNPSLIMWDALKYSLMSMEI<br>AARSEKTSTTPIYDVNALDKELKSSSGFVLSLLLKVVQSMRSKNSLHVLQRERGIQLFAESICSGTSIDNPGGRCKRGGN<br>MLSILKHADVEVSYPDIQFWNRASDPVLARDPESSLMWVLFCLPCQFILCKESLLSLVHVFYAVTLSQAVLSCCGKLQSK<br>VNELGESDSLISDISKLLGEFGSAQEYFVSNYIDPSCDIKDMIRRLSFPYLRRCALLWKLLNSTVPPPFSDRDHVLARSS<br>HGISDMMDSSDDALSDLKEIQEVEKMEKIPSLDVILKDEVLRSLVLKWFHHFSKEFEVHRFQHVLYSTPAVPFKLMCLPH<br>LYQDLLQRYIKQCCSDCKSVLDEPALCLLCGRLCSPSWKPCCRESSCQSHAVACGAGTGVFLLIRRTTILLQRCARQAPW<br>PSPYLDAFGEEDIEMHRGKPLYLNEERYAALTYMVASHGLDRSSKVLSQTTIGGFFLV (SEQ ID NO: 18)<br><br>> CsPRT6.3_KDO44131.1_CISIN_1g000141mg_*Citrus_sinensis*<br>MEIDSPPDFSPPKPRDRIVRRLMNIGVPEEFLDYSGIVNFAKNDKSRIPELVSTILPPDEEVAEVIQDAKAKNKKVSVGP<br>NMKGRFRESMLWLQWLMFEREPEKVLRKLSKIGQRGVCGAVWGNNDIAYRCRTCEHDPTCAICVPCFQNGNHKEHDYSII<br>YTGGGCCDCGDVTAWKREGFCSRHKGAEQIQPLPEKYANSAAPVLDALFIYWENKLSLAESVGQENPRASDHVAERRKLA<br>NELTFAVVEMLLEFCKNSESLLSFVSKRVISVIGLLDILVRAEMFSSDVVVRKLHELLLKLLGEPIFKYEFAKVFLSYYP<br>VFVKDAIREHSDDTIKKYPLLSTFSVQIFTVPTLTPRLVKEMNLLEMLLGCLREIFDSCAGDDSCLQVAKWANLYETTNR<br>VIGDIRFVMSHAAVSKYATHEQLNISKAWMKLLTFVQGMNPQKRETGIHIREENEYMHLPLVLDHSIANIQPLLVDGAFS<br>SAVSEETRYDFSMYKQDIGDGDSLRHAKVGRLSQESSVCGAMGRSSLSASTLKADDVIFDAVSDVLLPHSVTWVAHECLR<br>AMENWLGVDDRSVSVNDILSPNASRISGSNFVALKKTLSKIKKGKSIFSRLAGSSEVTAGIQESGDLDNATSMGKESKIT<br>ISGERDTASWRSAGFNDSEMEGECATELDNLHVLSLCYWPDITYDVSSQDVSVHIPLHRLLSLIIQKALRRCYGESAASE |

TABLE 3-continued

| Polypeptide sequence of citrus plant negative immune response regulators |
| --- |
| SADTGAENPLSAVSLDFFGHILGGCHPYGESAFVMEHPLRIRVFCAQVHAGMWRRNGDAALSSCEWYRAVRWSEQGLELD<br>LFLLQCCAALAPADLYVNRIIERFGLSNYLSLNLERPSEYEPILVQEMLTLIIQILQERRFCGLTTAESLKRELVHRLAI<br>GDATHSQLVKSLPRDLSKFDQLQEILDAVAMYSHPSGFNQGMYSLRWSYWKELDIYHPRWSSRDLQVAEERYLRFCSVSA<br>LTAQLPRWTKIYYPLESIAGIATCKVVLQVIRAVLFYAVFTDNPTDSRAPYGVLLTALHLLALALDVCFQKKKSGDQSCD<br>IGGSTPILDFASEEIAEGLNNGAGKQSLLSLLVFLMGMYKKDGADNFLEAGNCNLSSVIESLLKKFAEIDSRCMTKLQQL<br>APEIVSHLSQSLPRDDTSGSFSASDSEKRKAKARERQAAILEKMKAEQFKFLSSISSNIEDAPKSAPEVTNYDAEHVSEE<br>SVQDVCALCHDPNSRTPVSYLILLQKSRLLSFVDRGSPSWDQDQWLGKECGTISANNMVNQFGTNTPSSGLGVISSCQLA<br>QVAEEAVNQFAYNGKPEEVNSVLEFVKAQFPSLRNIPIPPFTFSNGRKCTASSMEMFEQDLYLSICREMRKNMTYPDLMKE<br>DEECSVAEGGLKNRGNSDSFLLGKYVASISKEMRENASASEVSRGDRIAAESLVYDGFGPIDCDGIHLSSCGHAVHQGCL<br>DRYVSSLKERYNRRIIFEGGHIVDPDQGEFLCPVCRQLANSVLPALPWDLQRINEQPTVSGVGLSLDSSSSFTTREENTS<br>FQLQQAVSLLQSASNVVGKADVIESFPLMKNEIMASNVEAVSRRMCKMYFQNKLDKFFGSARVNPSLIMWDALKYSLMSM<br>EIAARSEKTSTTPIYDVNALDKELKSSSGFVLSLLLKVVQSMRSKNSLHVLQRFRGIQLFAESICSGTSIDNPGGRCKRG<br>GNMLSILKHADVEVSYPDIQFWNRASDPVLARDPFSSLMWVLFCLPCQFILCKESLLSLVHVFYAVTLSQAVLSCCGKLQ<br>SKVNELGFSDSLISDISKLLGEFGSAQEYFVSNYIDPSCDIKDMIRRLSFPYLRRCALLWKLLNSTVPPPFSDRDHVLAR<br>SSHGISDMMDSSDDALSDLKEIQEVEKMEKIPSLDVILKDEVLRSLVLKWFHHFSKEFEVHRFQHVLYSTPAVPFKLMCL<br>PHLYQDLLQRYIKQCCSDCKSVLDEPALCLLCGRLCSPSWKPCCSCQSHAVACGAGTGVFLLIRRTTILLQRCARQAPWP<br>SPYLDAFGEEDIEMHRGKPLYLNEERYAALTYMVASHGLDRSSKVLSQTTIGGFFLV (SEQ ID NO: 19)<br><br>> CsPRT6.4_KDO44132.1_CISIN_1g000141mg_*Citrus_sinensis*<br>MEIDSPPDFSPPKPRDRIVRRLMNIGVPEEFLDYSGIVNFAKNDKSRIPELVSTILPPDEEVAEVIQDAKAKNKKVSVGP<br>NMKGRFRESMLWLQWLMFEREPEKVLRKLSKIGQRGVCGAVWGNNDIAYRCRTCEHDPTCAICVPCFQNGNHKEHDYSII<br>YTGGGCCDCGDVTAWKREGFCSRHKGAEQIQPLPEKYANSAAPVLDALFIYWENKLSLAESVGQENPRASDHVAERRKLA<br>NELTFAVVEMLLEFCKNSESLLSFVSKRVISVIGLLDILVRAEMFSSDVVVRKLHELLLKLLGEPIFKYEFAKVELSYYP<br>VFVKDAIREHSDDTIKKYPLLSTFSVQIFTVPTLTPRLVKEMNLLEMLLGCLREIFDSCAGDDSCLQVAKWANLYETTNR<br>VIGDIRFVMSHAAVSKYATHEQLNISKAWMKLLTFVQGMNPQKRETGIHIREENEYMHLPLVLDHSIANIQPLLVDGAFS<br>SAVSEETRYDFSMYKQDIGDGDSLRHAKVGRLSQESSVCGAMGRSSLSASTLKADDVIFDAVSDVLLPHSVTWVAHECLR<br>AMENWLGVDDRSVSVNDILSPNASRISGSNFVALKKTLSKIKKGKSIFSRLAGSSEVTAGIQESGDLDNATSMGKESKIT<br>ISGERDTASWRSAGFNDSEMEGECATELDNLHVLSLCYWPDITYDVSSQDVSVHIPLHRLLSLIIQKALRRCYGESAASE<br>SADTGAENPLSAVSLDFFGHILGGCHPYGFSAFVMEHPLRIRVFCAQVHAGMWRRNGDAALSSCEWYRAVRWSEQGLELD<br>LFLLQCCAALAPADLYVNRIIERFGLSNYLSLNLERPSEYEPILVQEMLTLIIQILQERRFCGLTTAESLKRELVHRLAI<br>GDATHSQLVKSLPRDLSKEDQLQEILDAVAMYSHPSGFNQGMYSLRWSYWKELDIYHPRWSSRDLQVAEERYLRFCSVSA<br>LTAQLPRWTKIYYPLESIAGIATCKVVLQVIRAVLFYAVFTDNPTDSRAPYGVLLTALHLLALALDVCFQKKKSGDQSCD<br>IGGSTPILDFASEEIAEGLNNGAGKQSLLSLLVFLMGMYKKDGADNFLEAGNCNLSSVIESLLKKFAEIDSRCMTKLQQL<br>APEIVSHLSQSLPRDDTSGSFSASDSEKRKAKARERQAAILEKMKAEQFKFLSSISSNIEDAPKSAPEVTNYDAEHVSEE<br>SVQDVCALCHDPNSRTPVSYLILLQKSRLLSFVDRGSPSWDQDQWLGKECGTISANNMVNQFGTNTPSSGLGVISSCQLA<br>QVAEEAVNQFAYNGKPEEVNSVLEFVKAQFPSLRNIPIPPFTFSNGRKCTASSMEMFEQDLYLSICREMRKNMTYPDLMKE<br>DEECSVAEGGLKNRGNSDSFLLGKYVASISKEMRENASASEVSRGDRIAAESLVYDGFGPIDCDGIHLSSCGHAVHQGCL<br>DRYVSSLKERYNRRIIFEGGHIVDPDQGEFLCPVCRQLANSVLPALPWDLQRINEQPTVSGVGLSLDSSSSFTTREENTS<br>FQLQQAVSLLQSASNVVGKADVIESFPLMKNEIMASNVEAVSRRMCKMYFQNKLDKFFGSARVNPSLIMWDALKYSLMSM<br>EIAARSEKTSTTPIYDVNALDKELKSSSGFVLSLLLKVVQSMRSKNSLHVLQRFRGIQLFAESICSGTSIDNPGGRCKRG<br>GNMLSILKHADVEVSYPDIQFWNRASDPVLARDPFSSLMWVLFCLPCQFILCKESLLSLVHVFYAVTLSQAVLSCCGKLQ<br>SKVNELGFSDSLISDISKLLGEFGSAQEYFVSNYIDPSCDIKDMIRRLSFPYLRSDMMDSSDDALSDLKEIQEVEKMEKI<br>PSLDVILKDEVLRSLVLKWFHHESKEFEVHRFQHVLYSTPAVPFKLMCLPHLYQDLLQRYIKQCCSDCKSVLDEPALCLL<br>CGRLCSPSWKPCCRESSCQSHAVACGAGTGVFLLIRRTTILLQRCARQAPWPSPYLDAFGEEDIEMHRGKPLYLNEERYA<br>ALTYMVASHGLDRSSKVLSQTTIGGFFLV (SEQ ID NO: 20)<br><br>>CuPRT6_GAY45099.1_CUMW_086920_*Citrus_unshiu*<br>MEIDSPPDFSPPKPRDRIVRRLINIGVPEEFLDYSGIVNFAKNDKSRIPELVSTILPPDEEVAEVIQDAKAKNKKVSVGP<br>NMKGRFRESMLWLQWLMFEREPEKVLRKLSKIGQRGVCGAVWGNNDIAYRCRTCEHDPTCAICVPCFQNGNHKEHDYSII<br>YTGGGCCDCGDVTAWKREGFCSRHKGAEQIQPLPEKYANSAAPVLDALFIYWENKLSLAESVGQENPRASDHVAERRKLA<br>NELTFAVVEMLLEFCKNSESLLSFVSKRVISVIGLLDILVRAERFSSDVVVRKLHELLLKLLGEPIFKYEFAKVFLSYYP<br>VFVKDAIREHSDDTIKKYPLLSTFSVQIFTVPTLTPRLVKEMNLLEMLLGCLREIFDSCAGDDSCLQVAKWANLYETTNR<br>VIGDIRFVMSHAAVSKYATHEQLNISKAWMKLLTFVQGMNPQKRETGIHIREENEYMHLPLVLDHSIANIQPLLVDGAFS<br>SAVAEETRYDFSMYKQDIGDGDSLRHAKVGRLSQESSVCGAMGRSSLSASTLKVDDVIFDAVSDVLLPHSVTWLAHECLR<br>AMENWLGVDDRSVSVNDILSPNASRISGSNFVALKKTLSKIKKGKSIFSRLAGSSEVTAGIQESGDLDNATSMGKESKIT<br>ISGERDTASWRSAGFNDSEMEGECATELDNLHVLSLCYWPDITYDVSSQDVSVHIPLHRLLSLIIQKALRRCYGESAASE<br>SADTGAENPLSAVSLDFFRHILGGCHPYGFSAFVMEHPLRIRVFCAQVHAGMWRRNGDAALSSCEWYRAVRWSEQGLELD<br>LFLLQCCAALAPADLYVNRIIERFGLSNYLSLNLERPSEYEPILVQEMLTLIIQILQERRFCGLTTAESLKRELVHRLAI<br>GDATHSQLVKSLPRDLSKFDQLQEILDAVAMYSHPSGFNQGMYSLRWSYWKELDIYHPRWSSRDLQVAEERYLRFCSVSA<br>LTAQLPRWTKIYYPLESIAGIATCKVVLQVIRAVLFYAVFTDNPTDSRAPYGVLLTALHLLALALDVCFQKKKSGDQSRD<br>IGGSTPILDFASEEIAEGLNNGAGKQSLLSLLVFLMGMYKKDGADNFLEAGNCNLSSVIESLLKKFAEIDSRCMTKLQQL<br>APEIVSHLSQSLPRDDTSGSFSASDSEKRKAKARERQAAILEKMKAEQFKFLSSISSNIEDAPKSAPEVTNYDAEHVSEE<br>SVQDVCALCHDPNSRTPVSYLILLQKSRLLSFVDRGSPSWDQDQWLGKECGTISANNMVNQFGTNTPSSALGVISSCQLA<br>QVAEEAVNQFAYNGKPEEVNAVLEFVKAQFPSLRNIPIPPFTFSNGRKCTASSMEMFEQDLYLSICREMRKNMTYPDLMKE<br>DEECSVAEGGLKNRGNSDSFLLGKYVASISKEMRENASASEVSRGDRIAAESLVYDGFGPIDCDGIHLSSCGHAVHQGCL<br>DRYVSSLKERYNRRIIFEGGHIVDPDQGEFLCPVCRQLANSVLPALPWDLQRINEQPTVSGVGLSLDSNSSFTTREENTS<br>LQLQQAVSLLQSASNVVGKADVIESFPLLKNEIMASNVEAVSRRMCKMYFQNKLDKFFGSARVNPSLIMWDALKYSLMSM<br>EIAARSEKTSTTPIYDVNALDKELKSSSGFVLSLLLKVVQSMRSKNSLHVLQRFRGIQLFAESICSGTSIDNPGGRCKRG<br>GNMLSILKHADVEVSYPDIQFWNRASDPVLARDPFSSLMWVLFCLPCQFILCKESLLSLVHVFYAVTLSQAVLSCCGKLQ<br>SKVNELGFSDSLISDISKLLGEFGSAQEYFVSNYIDPSCDIKDMIRRLSFPYLRRCALLWKLLNSTVPPPESDRDHVLAR<br>SSHGISDMMDSSDDALSDLKEIQEVEKMFKIPSLDVILKDEVLRSLVLKWFHHESKEFEVHRFQHVLYSTPAVPFKLMCL<br>PHLYQDLLQSVALIASLFLMNLLCACYVVDYVPQAGSHAAGKAVVKAMQWPVVLVLRTTILLQRCARQAPWPSPYLDAFG<br>EEDIEMHRGKPLYLNEERYAALTYMVASHGLDRSSKVLSQTTIGGFFLGKKTVLRNPKIAKLLVFNFMENKLRILDAGRL<br>ETNSFVAFWLRRAFALAYIYIYTPKALQIFISLNLNEFGVHRRSAAGKYTSSAPLNGCTVICKA (SEQ ID NO: 21)<br><br>> CsPRT6.5_KDO44134.1_CISIN_1g000141mg_*Citrus_sinensis*<br>MEIDSPPDFSPPKPRDRIVRRLMNIGVPEEFLDYSGIVNFAKNDKSRIPELVSTILPPDEEVAEVIQDAKAKNKKVSVGP<br>NMKGRFRESMLWLQWLMFEREPEKVLRKLSKIGQRGVCGAVWGNNDIAYRCRTCEHDPTCAICVPCFQNGNHKEHDYSII |

TABLE 3-continued

Polypeptide sequence of citrus plant negative immune response regulators

YTGGGCCDCGDVTAWKREGFCSRHKGAEQIQPLPEKYANSAAPVLDALFIYWENKLSLAESVGQENPRASDHVAERRKLA
NELTFAVVEMLLEFCKNSESLLSFVSKRVISVIGLLDILVRAEMFSSDVVVRKLHELLLKLLGEPIFKYEFAKVELSYYP
VFVKDAIREHSDDTIKKYPLLSTFSVQIFTVPTLTPRLVKEMNLLEMLLGCLREIFDSCAGDDSCLQVAKWANLYETTNR
VIGDIRFVMSHAAVSKYATHEQLNISKAWMKLLTFVQGMNPQKRETGIHIREENEYMHLPLVLDHSIANIQPLLVDGAFS
SAVSEETRYDFSMYKQDIGDGDSLRHAKVGRLSQESSVCGAMGRSSLSASTLKADDVIFDAVSDVLLPHSVTWVAHECLR
AMENWLGVDDRSVSVNDILSPNASRISGSNFVALKKTLSKIKKGKSIFSRLAGSSEVTAGIQESGDLDNATSMGKESKIT
ISGERDTASWRSAGFNDSEMEGECATELDNLHVLSLCYWPDITYDVSSQDVSVHIPLHRLLSLIIQKALRRCYGESAASE
SADTGAENPLSAVSLDFFGHILGGCHPYGFSAFVMEHPLRIRVFCAQVHAGMWRRNGDAALSSCEWYRAVRWSEQGLELD
LFLLQCCAALAPADLYVNRIIERFGLSNYLSLNLERPSEYEPILVQEMLTLIIQILQERRFCGLTTAESLKRELVHRLAI
GDATHSQLVKSLPRDLSKFDQLQEILDAVAMYSHPSGFNQGMYSLRWSYWKELDIYHPRWSSRDLQVAEERYLRFCSVSA
LTAQLPRWTKIYYPLESIAGIATCKVVLQVIRAVLFYAVFTDNPTDSRAPYGVLLTALHLLALALDVCFQKKKSGDQSCD
IGGSTPILDFASEEIAEGLNNGAGKQSLLSLLVFLMGMYKKDGADNFLEAGNCNLSSVIESLLKKFAEIDSRCMTKLQQL
APEIVSHLSQSLPRDDTSGSFSASDSEKRKAKARERQAAILEKMKAEQFKFLSSISSNIEDAPKSAPEVTNYDAEHVSEE
SVQDVCALCHDPNSRTPVSYLILLQKSRLLSFVDRGSPSWDQDQWLGKECGTISANNMVNQFGTNTPSSGLGVISSCQLA
QVAEEAVNQFAYNGKPEEVNSVLEFVKAQFPSLRNIPIPFTFSNGRKCTASSMEMFEQDLYLSICREMRKNMTYPDLMKE
DEECSVAEGGLKNRGNSDSFLLGKYVASISKEMRENASASEVSRGDRIAAESLVYDGFGPIDCDGIHLSSCGHAVHQGCL
DRYVSSLKERYNRRIIFEGGHIVDPDQGEFLCPVCRQLANSVLPALPWDLQRINEQPTVSGVGLSLDSSSSFTTREENTS
FQLQQAVSLLQSASNVVGKADVIESFPLMKNEIMASNVEAVSRRMCKMYFQNKLDKFFGSARVNPSLIMWDALKYSLMSM
EIAARSEKTSTTPIYDVNALDKELKSSSGFVLSLLLKVVQSMRSKNSLHVLQRFRGIQLFAESICSGTSIDNPGGRCKRG
GNMLSILKHADVEVSYPDIQFWNRASDPVLARDPFSSLMWVLFCLPCQFILCKESLLSLVHVFYAVTLSQAVLSCCGKLQ
SKVNELGFSDSLISDISKLLGEFGSAQEYFVSNYIDPSCDIKDMIRRLSFPYLRRCALLWKLLNSTVPPPESDRDHVLAR
SSHGISDMMDSSDDALSDLKEIQEVEKMFKIPSLDVILKDEVLRSLVLKWFHHFSKEFEVHRFQHVLYSTPAVPFKLMCL
PHLYQDLLQRYIKQCCSDCKSVLDEPALCLLCGRLCSPSWKPCCRESSCQSHAVACGAGTGVFLLIRVFSAPSFNRKLNI
IVLCVYCCACCLLA (SEQ ID NO: 22)

> CsPRT6.6_KDO44135.1_CISIN_1g000141mg_*Citrus_sinensis*
MEIDSPPDFSPPKPRDRIVRRLMNIGVPEEFLDYSGIVNFAKNDKSRIPELVSTILPPDEEVAEVIQDAKAKNKKVSVGP
NMKGRFRESMLWLQWLMFEREPEKVLRKLSKIGQRGVCGAVWGNNDIAYRCRTCEHDPTCAICVPCFQNGNHKEHDYSII
YTGGGCCDCGDVTAWKREGFCSRHKGAEQIQPLPEKYANSAAPVLDALFIYWENKLSLAESVGQENPRASDHVAERRKLA
NELTFAVVEMLLEFCKNSESLLSFVSKRVISVIGLLDILVRAEMFSSDVVVRKLHELLLKLLGEPIFKYEFAKVELSYYP
VFVKDAIREHSDDTIKKYPLLSTFSVQIFTVPTLTPRLVKEMNLLEMLLGCLREIFDSCAGDDSCLQVAKWANLYETTNR
VIGDIRFVMSHAAVSKYATHEQLNISKAWMKLLTFVQGMNPQKRETGIHIREENEYMHLPLVLDHSIANIQPLLVDGAFS
SAVSEETRYDFSMYKQDIGDGDSLRHAKVGRLSQESSVCGAMGRSSLSASTLKADDVIFDAVSDVLLPHSVTWVAHECLR
AMENWLGVDDRSVSVNDILSPNASRISGSNFVALKKTLSKIKKGKSIFSRLAGSSEVTAGIQESGDLDNATSMGKESKIT
ISGERDTASWRSAGENDSEMEGECATELDNLHVLSLCYWPDITYDVSSQDVSVHIPLHRLLSLIIQKALRRCYGESAASE
SADTGAENPLSAVSLDFFGHILGGCHPYGFSAFVMEHPLRIRVFCAQVHAGMWRRNGDAALSSCEWYRAVRWSEQGLELD
LFLLQCCAALAPADLYVNRIIERFGLSNYLSLNLERPSEYEPILVQEMLTLIIQILQERRFCGLTTAESLKRELVHRLAI
GDATHSQLVKSLPRDLSKEDQLQEILDAVAMYSHPSGFNQGMYSLRWSYWKELDIYHPRWSSRDLQVAEERYLRFCSVSA
LTAQLPRWTKIYYPLESIAGIATCKVVLQVIRAVLFYAVFTDNPTDSRAPYGVLLTALHLLALALDVCFQKKKSGDQSCD
IGGSTPILDFASEEIAEGLNNGAGKQSLLSLLVFLMGMYKKDGADNFLEAGNCNLSSVIESLLKKFAEIDSRCMTKLQQL
APEIVSHLSQSLPRDDTSGSFSASDSEKRKAKARERQAAILEKMKAEQFKFLSSISSNIEDAPKSAPEVTNYDAEHVSEE
SVQDVCALCHDPNSRTPVSYLILLQKSRLLSFVDRGSPSWDQDQWLGKECGTISANNMVNQFGTNTPSSGLGVISSCQLA
QVAEEAVNQFAYNGKPEEVNSVLEFVKAQFPSLRNIPIPFTFSNGRKCTASSMEMFEQDLYLSICREMRKNMTYPDLMKE
DEECSVAEGGLKNRGNSDSFLLGKYVASISKEMRENASASEVSRGDRIAAESLVYDGFGPIDCDGIHLSSCGHAVHQGCL
DRYVSSLKERYNRRIIFEGGHIVDPDQGEFLCPVCRQLANSVLPALPWDLQRINEQPTVSGVGLSLDSSSSFTTREENTS
FQLQQAVSLLQSASNVVGKADVIESFPLMKNEIMASNVEAVSRRMCKMYFQNKLDKFFGSARVNPSLIMWDALKYSLMSM
EIAARSEKTSTTPIYDVNALDKELKSSSGFVLSLLLKVVQSMRSKNSLHVLQRFRGIQLFAESICSGTSIDNPGGRCKRG
GNMLSILKHADVEVSYPDIQFWNRASDPVLARDPFSSLMWVLFCLPCQFILCKESLLSLVHVFYAVTLSQYYHVVGNFNP
RLMS (SEQ ID NO: 23)

> CsPRT6.7_KDO44136.1_CISIN_1g000141mg_*Citrus_sinensis*
MEIDSPPDFSPPKPRDRIVRRLMNIGVPEEFLDYSGIVNEAKNDKSRIPELVSTILPPDEEVAEVIQDAKAKNKKVSVGP
NMKGRFRESMLWLQWLMFEREPEKVLRKLSKIGQRGVCGAVWGNNDIAYRCRTCEHDPTCAICVPCFQNGNHKEHDYSII
YTGGGCCDCGDVTAWKREGFCSRHKGAEQIQPLPEKYANSAAPVLDALFIYWENKLSLAESVGQENPRASDHVAERRKLA
NELTFAVVEMLLEFCKNSESLLSFVSKRVISVIGLLDILVRAEMFSSDVVVRKLHELLLKLLGEPIFKYEFAKVELSYYP
VFVKDAIREHSDDTIKKYPLLSTFSVQIFTVPTLTPRLVKEMNLLEMLLGCLREIFDSCAGDDSCLQVAKWANLYETTNR
VIGDIRFVMSHAAVSKYATHEQLNISKAWMKLLTFVQGMNPQKRETGIHIREENEYMHLPLVLDHSIANIQPLLVDGAFS
SAVSEETRYDESMYKQDIGDGDSLRHAKVGRLSQESSVCGAMGRSSLSASTLKADDVIFDAVSDVLLPHSVTWVAHECLR
AMENWLGVDDRSVSVNDILSPNASRISGSNFVALKKTLSKIKKGKSIFSRLAGSSEVTAGIQESGDLDNATSMGKESKIT
ISGERDTASWRSAGFNDSEMEGECATELDNLHVLSLCYWPDITYDVSSQDVSVHIPLHRLLSLIIQKALRRCYGESAASE
SADTGAENPLSAVSLDFFGHILGGCHPYGFSAFVMEHPLRIRVFCAQVHAGMWRRNGDAALSSCEWYRAVRWSEQGLELD
LFLLQCCAALAPADLYVNRIIERFGLSNYLSLNLERPSEYEPILVQEMLTLIIQILQERRFCGLTTAESLKRELVHRLAI
GDATHSQLVKSLPRDLSKEDQLQEILDAVAMYSHPSGFNQGMYSLRWSYWKELDIYHPRWSSRDLQVAEERYLRFCSVSA
LTAQLPRWTKIYYPLESIAGIATCKVVLQVIRAVLFYAVFTDNPTDSRAPYGVLLTALHLLALALDVCFQKKKSGDQSCD
IGGSTPILDFASEEIAEGLNNGAGKQSLLSLLVFLMGMYKKDGADNFLEAGNCNLSSVIESLLKKFAEIDSRCMTKLQQL
APEIVSHLSQSLPRDDTSGSFSASDSEKRKAKARERQAAILEKMKAEQFKFLSSISSNIEDAPKSAPEVTNYDAEHVSEE
SVQDVCALCHDPNSRTPVSYLILLQKSRLLSFVDRGSPSWDQDQWLGKECGTISANNMVNQFGTNTPSSGLGVISSCQLA
QVAEEAVNQFAYNGKPEEVNSVLEFVKAQFPSEMRKNMTYPDLMKEDEECSVAEGGLKNRGNSDSFLLGKYVASISKEMR
ENASASEVSRGDRIAAESLVYDGFGPIDCDGIHLSSCGHAVHQGCLDRYVSSLKERQVLPTTKGNLILLLNATDLLITWL
FSISQDDLLENVDKVLEWAILTGFALLCFLFESFHYIMQLHL (SEQ ID NO: 24)

>AbPRT6_sb36751.5_*Atalantia_buxifolia*
MEIDPPPDFSPPKPRDRIVRRLINIGVLEEFLDYSGIVNFAKNDRSRIPE
LVSTILPPDEEVAEVIQDAKAKNKKISVGLNMKGRFRESMLWLQWLMFER
EPEKVLRKLSKIGQRGVCGAVWGNNDIAYRCRTCEHDPTCAICVPCFQNG
NHKEHDYSIIYTGGGCCDCGDVTAWKREGFCSRHKGAEQIQPLPEKYANS
AVPVLDALFIYWENKLSSAESVGQENPRASDHVAERRKLANELTFAVVEM
LLEFCKNSESLLSFVSKRVISVVGLLDILVRAERFLNDVVVRKLHELLLK TABLE 3-continued

| Polypeptide sequence of citrus plant negative immune response regulators |
|---|

LLGEPIFKYEFAKVFLSYYPVFVKDAIREHSDDTIKKYPLLSTFSVQIFT
VPTLTPRLVKEMNLLEMLLECLREIFDSCAGDNSCLQVAKGANLYETTNR
VIGDIRFVMSHAAVSKYATHEQLDISKTWLKLLTFVQGMNPQKRETGIPI
REETEYMHLPLVLDHSIANIQPLLVDGAFSSAVAEETCYDFSMYKQDIGD
GDSLRHAKVGRLSQESSVCGAMGRSSLSASTLKADDVIVDAISDVLLPHS
VTWIAHECLRAMENWLGVNDRSVSVNDIVSPNASRISGSNFVALKKTLSK
IKKGKSIFSRLAGSSEVTAGIQESGDLDNATSMGKESKITISGERDTASW
RSAGFNDSQMEGECATELDNLHVLSLCYWPDIMYDVSSQDVSVHIPLHRL
LSLIIQKALRRCYGESAASESADTGAENPLSAVSLDFFGHVLGGCHPYGF
SAFVMEHPLRIRVFCAQVHAGMWRRNGDAALSSCEWYRAVRWSEQGLELD
LFLLQCCAALAPADQYVNRIIERFGLSNYLSLNLERPSEYEPILVQEMLT
LIIQILQERRFCGLTTAESLKRELVHRLAIGDTTHSQLVKSLPRDLSKFD
RLQEILDAVAMYSHPSGFNQGMYSLRWSYWKELDIYHPRWSSRDLQVAEE
RYLRFCSVSALTSQLPRWTKIYFPLESIAGIATCKVVLQVIHAVLFYAVF
TDKPTDSRAPYGALLTALHLLALALDVCFQKKKSGDQSCDIGGSTPILDF
ASDEIAEGLNNGAGKQSLLSLLVFLMGMYKKDGAANFLEAGNCNLSSLIE
SLLKKFAEIDSRCMTKLQQLAPEIVSHLSQSLPRDDTSGSFSASDSEKRK
AKARERQAAILEKMKAEQFKELSSISSNIEDAPKSAPEVTNYDAEHVSEE
SVQDVCALCHDPNSRTPVSYLILLQKSRLLSFVDRGSPSWDQDQWLGKEC
GAISANNMVNQFGTNTPSSGLGVISSCQLAQVAEEAVNQFAYNGKPEEVN
AVLEFVKAQFPSLRNIQIPFTFSNGRKCTASSMEVFEQDLYLSICREMRK
NMTCPDLMKEDEECSVAEGGLKNRGNSDSVLLGKYVASISKEMRENPSAS
EVSHGDRIAAESLVYDGEGPIDCDGIHLSSCGHAVHQGCLDRYVSSLKER
YNRRIIFEGGHIVDPDQGEFLCPVCRQLANSVLPALPWDLORINEQPTLS
GVGLSLDSNSSFTPREENTSLQLQQAASLLQSASNVVGKADVIESFPLMK
NEIMASNVEGVSRRMCKMYFQNKLDKFFGSARVNPSLIMWDALKYSLMSM
EIAARSEKTSMTPIYDVNALDKELKSSSGFVLSLLLKVVQSMRSKNSLHV
LQRFRGIQLFAESICSGTSIDNPGGRCKRGGNMLSILKHADVEVSYPDIQ
FWNRASDPVLARDPFSSLMWVLFCLPCQFILCKESLLSLVHVFYAVTLSQ
AVLSCCGKLQSKVNELGESDSLISDISKLLGEFGSAQEYFVSNYIDPSCD
IKDMIRRLSFPYLRRCALLWKLLNSTVPPPFSDRDHVLARSSHGISDMMD
SSDDALSDLKEIQEVEKMFKIPSLDVILKDKVLRSLVLKWFHHFFKEFEV
HRSQRVLYSTPAVPFKLLRLPHLYQDLLQRYIKQCCPDCNSVLDEPALCL
LCGRLCSPSWKPCCRESSCQSHAMACGAGTGVFLLIRRTTILLQRCARQA
PWPSPYLDAFGEEDIEMHRGKPLYLNEERYAALTYMVASHGLDRSSKVLS
QTTIGGFFLV- (SEQ ID NO: 25)

>SlPRT6_Solyc10g084760.1 sequence match in blast db Tomato Genome protein sequences (ITAG release 2.40)
MDTGSSPESDTLTPMERILKRLDILGVPAEYLELLQPGLVAYVKNNKSQIAELVPALFPTNEEAVEIIAEQQIQSPRSMV
SSSVNVKDLFQESMEWIQWLMFDGEPSRALEQLEDTGQRGVCGAVWGNNDIAYRCRTCEHDPTCAICVPCFQNGNHKDHD
YSIIYTGGGCCDCGDVTAWKREGFCSKHKGAEQIQPLPEEFANSMGPVLDLLLSCWRKRFLFPDSISGRNPRKNDHSTEL
KMVTDELTSAVVKMLLKFCKHSESLLSFISRRVSSSAGLLDILVRAERFMIIEENVKKIHELLLKLLGEPQFKYEFAKVF
LSYYPTVVNEATSECNDSVYNKYPLLSTFSVQIFTVPTLTPRLVKEMNLLPMLLGCLGDIFASCAGEDGKLQVMKWSNLY
ETTLRVVEDIRFVMSHSVVPRYVTHERRDILRTWMKLLAFVQGANPQKRETGIHVEEENENMHLPFVLGHSIANIHSLLV
SGAFSTSSTEDGADAFFNTHREDFEDQDSQRHAKVGRLSQESSVCSMAGRSPLEHASRVLEVHYDSSPISSSVLCLTFEC
LRAIENWLIVDNTSGPLLHILCPKTSSTPGNNFSVLKKTLSKFRRGREMFKSQSPPSNDVRLVTSAEGYNKQYSNPSLNG
RTILDSGLGSGQEPACLGGHDDSMLEGDNASELGELRLLSLSDWPDIVYKVSLQDISVHNPLQRLLSMVLQKALGKCYGE
NAQPVASSAKLSSSVHYDFFGHILGVYHPQGFSAFIMEHALRIRVFCAQVYAGMWRRNGDSAILSCEWYRSVRWSEQGLE
LDLFLLQCCAALAPADLYISRILERFELSNYLSFNLERPSEYEPALVQEMLTLIIQILKERRFCGLTSSECLORELVYRL
SIGDATHSQLVKSLPRDLSKIDKFQEVLDKIAIYSNPSGMNQGMYKLRLPYWKELDLYHPRWNSRDLQVAEERYMRFCNA
SALTTQLPGWSKIYPPLGRIAEVATCRTVLQIVRAVVSYAVFSDASNASCAPDGVLLRALHLLSLALDICHAHRESGEHS
CSNGDVIPILALACEEISVGKFGDQSLLSLLVLLMRKHKKENYFVEAGMLNLLSLVESVLKKFAELQPECMKKLQDLAPD
VVNQLSRSFPAGDMNSFKSVSDSDKHKAKARERQAAMLEKMRVQQSKFLASIDSKTDVAADDSKHGKDLCDSDGRPRSEE
ATPVICSLCRDPNSRSPVSYLILLQKSRLLSCTNRGPPSWEQTRRPGKEPTSCAKHVPNISSERSNLSRSSEITSSSCLM
QLIQNKVNEFALEGQPKEVEAFLEYIKEKFPSMKNIQPSCASSTVKKKTSSSFEMLEEHMYSLIWEEMDANSWNWDLLKN
DRKLSALGDNGSAESLLLGRYISALSRECSPSASTNSRKAQLESSMLLPTYNGFGPSDCDGIYLSSCGHAVHQGCLDRYL
SSLKERYTRQIVFEGGHIVDPDQGEFLCPVCRGLANSVLPALPAETKRSTPSLSTDPSDAVGLPTLRFQEVLFLLQSAAD
VAGSREILQSLPVQQFGQMRVNLDYVVRILCEMYFPDKDKISESGRLSHSLILFDTLKYSLISTEIAARSGNTSLAPNYS
LGALYKELKSTNCFILALLLSIVQSTRSKDSLTVLLRLRGIQLFVKSICSDISADEYPDSPIVGGNMQDILEFSETELQY
PDIQFWKRCSDPVLAHDAFSSLTWVLYCLPCQFLSCEKSFLCLVHLFYVVTITQIVITYSRKLQSSLSMSGCSDSLVTDI
YRIIAENGVAYKDFDSNHIETHDVKDAIRSLSFPYLRRCALLWKLVRSSVSAPFSGGSNILDGLPYSMGETMECGGNIPV
EFNEIEKLEKLFKIPPLDDVISDETVRFVVPSWLRRFSKQFEARMLNGAMYSSPAVPFKLMLLPHLYQDLLQRYIKQNCP
DCGVVLEEPALCLLCGRLCSPNWKPCCRESGCQTHAMACGAGTGVFLLIKKTTVLLQRSARQASWPSPYLDAFGEEDSGM
NRGKPLYLNEERYAALTHMVASHGLDRSPKVLHQTNIGNFFVL (SEQ ID NO: 26)

>StPRT6_XP_006339028.1 PREDICTED: E3 ubiquitin-protein ligase PRT6-like isoform X3 [*Solanum tuberosum*]
METDSSPESDTLTPMERILQRLDILGVPAENLEQLQPGLVAYVKNNKSQIAELVPALLPTNEEAMEIITE
QQMESPRSTVSSSVNVKDLFQESMDWIQWLMEDGEPSRALEQLEDTGERGVCGAVWGNNDIAYRCRTCEH
DPTCAICVPCFQNGNHKDHDYSIIYTGGGCCDCGDVTAWKREGFCSKHKGAEQIKPLPEEFANSMGPVLD
LLLSCWRKRLLFPDSISGRNPRRNDHATELKMVTDELTSAVVEMLLKFCKHSESLLSFISRRVSCSAGLL
DILVRAERFMITEENVKKIHELLLKLLGEPQFKYEFAKVFLSYYPTVVNEATRECNDSVFNKYPLLSTFS
VQIFTVPTLTPRLVKEMNLLPMLLGCLGDIFASCAGEDGKLQVMKWSDLYETTLRVVEDIRFVMSHSVVP
RYATHDRRDILRTWIKLLAFVQGTDPQKRETGIHVEEESENMHLPFVLGHSIANIHSLLVGGAFSISTED
AADAFFNTHTEDFEDQDSQRHAKVGRLSQESSVCSMAGRSPLEHASRVPEVTYDSSPISSSVLCLTFECL
RAIENWLIVDNTSGALLHILCPKTSSTPGNNFSMLKKTLSKFRRGREMFKSQSPPSNEVRLLTSAEGYNK
QYSNPSLNGRTTLDSGQGSGQEAACLGGLDDSMLEGDNASELEALRLLSLSDWPDIVYKVSLQDISVHNP TABLE 3-continued

| Polypeptide sequence of citrus plant negative immune response regulators |
|---|
| LHRLLSMVLQRALGKCYGESAQPVASSAKLSSSVHYDFFGHILGGYHPQGESAFIMEHALRIRVFCAQVH<br>AGMWRRNGDAAILSCEWYRSVRWSEQGLELDLFLLQCCAALAPADLYISRILERFELSNYLLFNLERPSE<br>YEPTLVQEMLTLIIQILRERRFCGLTSSECLQRELVYRLSIGDATHSQLVKSLPRDLSKIDKFQEVLDKI<br>AIYSNPSGMNQGMYKLRLPYWKELDLYHPRWNSRDVQVAEERYMRFCNASALTTQLPGWSKIYPPLGRIA<br>EVATCRTVLQIVRAVVSYAVFSDASNASRAPDGVLLRALHLLSLALDICHAQRESGEHSCYNGDVIPILA<br>LACEEISVGKFGDQSLLSLLVLLMRKHKKENYFVEAGMLNLLSLVESVLKKFAELQPECMKKLQDLAPDV<br>VNQLSRSFPSGDMNSFRSFSDSDKHKAKARERQAAMLEKMRVQQSKFLASIDSTTDVAADDSKHGKDLCD<br>SDGRPRSEEATPVICSLCRDPNSRSPVSHLVLLQKSRLLSCTNRGPPSWEQTRRPGKEPTSCAKQVPNIS<br>SERSNLSRSSEITSSSWLMQLIQNKVNEFALEGQPKEVEAFLEYIKEKFPLMKNIQPSCASSTVKKKTSS<br>SFEMLEEHMYSLIWEEMDANSRNWDLLKNDRKLSALGDNGSAESLLLGRYISALSRECSPSASTNSRKAQ<br>LESSMLLPTYKGFGPSDCDGIYLSSCGHAVHQGCLDRYLSSLKERYTRQIVFEGGHIVDPDQGEFLCPVC<br>RGLANSVLPALPAETKRSTPSLSTGPSDAVGLSTLRFQEALFLLQSAADVAGSREILQSLPLQQFGQMRV<br>NLDYVVRVLCEMYFPDKDKISESGRLSHSLILFDTLKYSLMSTEIAARSGNTSLAPNYSLGALYKELKST<br>NCFIFALLLSIVQSTRTKDSLTVLLRLRGIQLFVKSICSDISADECPDSPIVGGNMQDILEFSETELQYP<br>DIQFWKRSSDPVLAHDAFSSLMWVLYCLPCQFLSCEKSFLCLVHLFYVVSITQIVITYSRKRQSSLSMSG<br>CSDSLVTDIYRIIEENGVAYIYFDSNHIETHDVKDAIRSLSFPYLRRCALLWKLVRSSVSAPFSGGSNIL<br>DGLPYSMGETMECGGNIPVEFNEIEKLEKLFKIPPLDDVISDEIVRFVVPRWLRHFSKQFEARTLNGVMY<br>STPAVPFKLMLLPHLYQDLLQRYIKQHCPDCGVVLEEPALCLLCGRLCSPNWKPCCRESGCQTHAMACGA<br>GTGVFLLIKKTTVLLQRSARQASWPSPYLDAFGEEDSGMNRGKPLYLNEERYAALTHMVASHGLDRSPKV<br>LHQTNIGNFLML (SEQ ID NO: 27) |

| OPT1 protein Sequences |
|---|
| > PtOPT1_Ptrif.0001s1849.1_ *Poncirus_trifoliata*<br>MTLYDHDGSVPQSEYSDRHLRISGDGEVNDNPIEEVRLTVPITDDPSLPV<br>LTFRTWVLGILSCGLLAFLNRFFGFRQNQLTVSSVSAQILVLPIGKLMAA<br>TLPTKKFKCPITNWSFSENPGPFNIKEHVLITIFASCGASGVYAVHIIAM<br>LRAFYKRSIHPVAALLLALTTQMLGYGWAGIFRRYLVDSPYMWWPANLVQ<br>VSLFRALHEKEKRPKGGLTRIQFFFVVFVSSFAYYIVPGYLFPSLTALSF<br>VCWIWKRSVTAQQIGSGLSGLGIGAIGIDWSTVSSFLGSPLATPLFAIVN<br>TLVGFALVMYILLPISYWNNVYEAKRFPIFGAATFDAQGRKYNVDRVLNK<br>ETFDLNVEAYNGYSKLYLSVFFAFTYGLSFATLTASISHVALEDGKSIME<br>MWMKTKDAVGDKFADVHTRMMKSNYDSVPGWWFHAVLVVSVALALYACEG<br>FGKVLQLPWWGLLLACLIALGFTLPIGIINATTNQQPGLNVITELIIGFL<br>YPGKPVANVVFKTYGYISMAQALAFLSDFKLGHYMKIPPKSMFIVQLVGT<br>VVASSVYFVTAWWLLGSIKDICDTAALPEGSPWTCPGDDVFYSASIIWGV<br>IGPGKMFTKEGIYPEMNWCFLIGFLAPVPVWLLSRKFPKKRWIKQIHMPI<br>IIGTASSMPTAKAVHFNTWGVVGIFFNYYIYRKYKAWWARHTYILSGALD<br>AGIAFMGVVIYFALQNYDNFGPNWWGLDSGDHCPLAKCPTAPGVKSKGCP<br>VQ- (SEQ ID NO: 28)<br><br>> PtOPT1.2_ Ptrif.0001s1850.2_ *Poncirus_trifoliata*<br>MGSRNFEEDGVPQALSLEKPQTEIKIIGDEEVNDSPIEQVRLTVPITDDP<br>SQPALTFRTWFLGIVSCVVLSFLNRFFGFRQNQLSVGSISAQIIVLPLGK<br>LMAATLPSKPIRLPFTKWTFSMNPGPENLKEHVLITIFANCGAGGVYAVY<br>IITIVKAFYKRKLNPLAAMLLAQTTQLLGYGWAGLFRKYLVDSPFMWWPA<br>NLVQVSLFRALHEKEKRPKGGLTRLQFFFMVFASSFAYYVVPGYLFPTLS<br>ALSFVCWIWKNSVTAQQIGAGLNGLGIGSFGLDWSTVASFLGSPLASPVF<br>AIINVLAGFILNLYVLVPIAYWTNTYEAKRFPIFSSHTFDSTGQPYNISR<br>ILNEATFDLDHDAFNSYSKLYLSPFFAFNYGLSFATLTATISHVALFDGS<br>DIWQMWKRTTSAARDKFADVHTRLMKKHYEAVPQWWFHIILVATVALSIY<br>ACEGFDKQLQLPWWGILLACAIALFFTLPIGIIQATTNQQPGLNVITELI<br>IGYMYPGRPLANVAFKTYGYISMSQALSFLADFKLGHYMKIPPKSMELVQ<br>LIGTVVASSVYFGTAWWLLTSVEHICDPSALPEGSPWTCPGDDVFYSASI<br>IWGIVGPGKMFTKEGVYPALNWFFLVGLLAPVPIWFLSRKFPEIKWIGLI<br>HIPIIFGGTGNMPPARAVHYLSWAAVGIFFNYYVYRRFKGWWARHTYILS<br>AALDAGVAFMGVFLFLTLQSYDIFGPHWWGLDSTDHCPLATCPTAPGIVI<br>KGCPVF- (SEQ ID NO: 29)<br><br>> PtOPT1.3_ Ptrif.0001s1852.1_ *Poncirus_trifoliata*<br>MCASHSAMSFTFQFKDRDMGTYVEGGMLQSMSPENSQTDTRTKGDMEEAN<br>DNPIEEVRLTVPITDDPTIPALTFRTWVLGLTSCCLLAFVNQFFGYRQNQ<br>LYMSSISAQILVLPIGKLMAATLPSKPIPVPLTPWSFSLNPGPFNLKEHV<br>LITIFAGCGSSGVYAVSIITIVKAFYKRSLHILPAMMLVQTTQLLGYGWA<br>GLFRKYLVDSPYMWWPANLVQVSLFRALHEEEKRTKGGLTRLQFFVIVFI<br>SSFAYYVVPGYLFPSISALSFVCWIWKDSVTAQKLGSGLQGLGMGSFGLD<br>WATVAGFLGSPLATPFFAIANILVGFFLFLYILIPIAYWCNAFEAQRFPL<br>FSSHTEDYGGQIYNVSRILNEKEFSFDREGYDNYSRLYLSVLFAFIYGLG<br>FATLMASISHVALFEGKTIWQMWRKTTAAVKQQFGDVHTRLMKKNYEAVP<br>QWWFHAILIITFALSLFTCEGFDKQFQLPWWGLLLACAMAFFFTLPVGVI<br>QATTNLQPGLNIITEMVIGYMYPGKPLANVAFKTYGYISMVQALGFLGDF<br>KLGHYMKVPPKSMFVVQLVGTIVASTVYFGTAWWLLTSVEHICNPSLLPE |

TABLE 3-continued

| Polypeptide sequence of citrus plant negative immune response regulators |
|---|

GSPWTCPGDEVFYNASIIWGVVGPLRMFTNYGNYPQMNWFFLIGFLAPFP
VWLLSRKFPEKKWIKNIHMPLLLAGPGGLPSAKAVNYLSWGAVGIFFNYY
VYRRFKGWWARHTYILSAALDAGVAFMGVFLYFTLQSQDIFGPEWWGLAA
TDHCPLAKCPIAPGIKVQGCRVA- (SEQ ID NO: 30)

>XP_006452632.2 oligopeptide transporter 1 [*Citrus clementina*]
MTLYDHDGSVPQSEYSDRHLRISGDGEVNDNPIEEVRLTVPITDDPSLPVLTFRTWVLGILSCGLLAFLNRFFGFRQNQL
TVSSVSAQILVLPIGKLMAATLPTKKFKCPITNWSFSFNPGPFNIKEHVLITIFASCGASGVYAVHIIAMLRAFYKRSIH
PVAALLLALTTQMLGYGWAGLFRRYLVDSPYMWWPANLVQVSLFRALHEKEKRPKGGLTRIQFFFVVFVSSFAYYIVPGY
LFPSLTALSFVCWIWKRSVTAQQIGSGLSGLGIGAIGIDWSTVSSFLGSPLATPLFSIVNTLVGFALVMYILLPIFYWNN
VYEAKRFPIFSAATFDAQGHKYNVDRVLNKETFDLNVEAYNGYSKLYLSVFFAFIYGLSFATLTASISHVALFDGKNIME
MWMKTKDAVGDKFADVHTRMMKRNYDSVPGWWFHAVLVVSVALALYACEGFGKVLQLPWWGLLLACLIALGFTLPIGIIN
ATTNQQPGLNVITELIIGFLYPGKPVANVVFKTYGYISMAQALAFLSDFKLGHYMKIPPKSMFIVQLVGTVVASSVYFGT
AWWLLGSIKDICDPAALPEGSPWTCPGDDVFYSASIIWGVIGPGKMFTKEGIYPEMNWCFLIGFLAPVPVWLLSRKFPKK
RWIKQIHMPIIGTASSMPTAKAVHFNTWGVVGIFFNYYIYRKYKAWWARHTYILSGALDAGIAFMGVVIYFALQNYDNF
GPNWWGLDSGDHCPLAKCPTAPGVKSKGCPVR (SEQ ID NO: 31)

>GAY47750.1 hypothetical protein CUMW_106760 [*Citrus unshiu*]
MGSRNFEEDGVPQALSLEKPQTEIKIIGDEEVNDSPIEQVRLTVPITDDPSQPALTFRTWFLGIISCVVLSFLNRFFGFR
QNQLSVGSISAQIIVLPLGKLMAATLPSKPIRVPLTKWTFSMNPGPFNLKEHVLITIFANCGAGGVYAVYIITIVKAFYK
RKLNPLAAMLLAQTTQLLGYGWAGLFRKYLVDSPFMALHEKEKRPKGGLTRLQFFFMVFASSFAYYVVPGYLFPTLSALS
FVCWIWKNSVTAQQIGAGLNGLGIGSFGLDWSTVASFLGSPLASPVFAIINVLAGFILNLYVLVPIAYWTNTYEAKRFPI
FSSHTFDSTGQPYNISRILNEATFDLDHDAFNSYSKLYLSPFFAFNYGLSFATLTATISHVALFDGSDIWQMWKRTTSAA
RDKFADVHTRLMKKHYEAVPQCYNSHGGEFYWLVLLLYSLPYLLQPGLNVITELIIGYMYPGRPLANVAFKTYGYISMSQ
ALSFLADFKLGHYMKIPPKSMFLVQLIGTVVASSVYFGTAWWLLTSVEHICDPSALPEGSPWTCPGDDVFYSASIIWGIV
GPGKMFTKEGVYPALNWFFLVGLLAPVPIWFLSRKFPEIKWIRLIHIPIIFGGTGNMPPARAVHYLSWAAVGIFFNYYVY
RRFKGWWARHTYILSAALDAGVAFMGVFLFLTLQSYDIFGPHWWGDGEVNDNPIEEVRLTVPITDDPSLPVLTFRTWVLG
ILSCGLLAFLNRFFGFRQNQLTVSSVSAQILVLPIGKLMAATLPTKKFKCPITNWSFSFNPGPFNIKEHVLITIFASCGA
SGVYAVHIIAMLRAFYKRSIHPVAALLLALTTQMLGYGWAGIFRRYLVDSPYMWWPANLVQVSLFRALHEKEKRPKGGLT
RIQFFFVVFVSSFAYYIVPGYLFPSLTALSFVCWIWKRSVTAQQIGSGLSGLGIGAIGIDWSTVSSFLGSPLATPLFAIV
NTLVGFALVMYILLPIFYWNNVYEAKRFPIFGAATFDAQGHKYNVDRVLNKETFDLNVEAYNGYSKLYLSVFFAFTYGLS
FATLTASISHVALFDGKSIMEMWMKTKDAVGDKFADVHTRMMRRNYDSVPGWWFHAVLVVSVALALYACEGFGKVLQLPW
WGLLLACLIALGFTLPIGIINATTNQQPGLNVITELIIGFLYPGKPVANVVFKTYGYISMAQALAFLSDFKLGHYMKIPP
KSMFIVQLVGTVVASSVYFGTAWWLLGSIKDICDTAALPEGSPWTCPGDDVFYSASIIWGVIGPGKMFTKEGIYPEMNWC
FLIGFLAPVPVWLLSRKFPKKRWIKQIHMPIIGTASSMPTAKAVHFNTWGVVGIFFNYYIYRKYKAWWARHTYILSGAL
DAGIAFMGVVIYFALQNYDNFGPNWWGLDSGDHCPLAKCPTAPGVKSKGCPVQ (SEQ ID NO: 32)

>GAY47748.1 hypothetical protein CUMW_106760 [*Citrus unshiu*]
MGSRNFEEDGVPQALSLEKPQTEIKIIGDEEVNDSPIEQNQLSVGSISAQIIVLPLGKLMAATLPSKPIRVPLTKWTFSM
NPGPFNLKEHVLITIFANCGAGEKHRNLLILFDEIQLLGYGWAGLFRKYLVDSPFMWWPANLVQVSLFRALHEKEKRPKG
GLTRLQFFFMVFASSFAYYVVPGYLFPTLSALSFVCWIWKNSVTAQQIGAGLNGLGIGSFGLDWSTVASFLGSPLASPVF
AIINVLAGFILNLYVLVPIAYWTNTYEAKRFPIFSSHTFDSTGQPYNISRILNEATFDLDHDAFNSYSKLYLSPFFAFNY
GLSFATLTATISHVALFDGSDIWQMWKRTTSAARDKFADVHTRLMKKHYEAVPQWWFHIILVATVALSIYACEGFDKQLQ
LPWPLANVAFKTYGYISMSQALSFLADFKLGHYMKIPPKSMFLVQLIGTVVASSVYFGTAWWLLTSVEHICDPSALPEGS
PWTCPGDDVFYSASIIWGIVGTGNMPPARAVHYLSWAAVGIFFNYYVYRRFKGWWARHTYILSAALDAGVAFMGVFLFLT
LQSYDIFGPHWWGDGEVNDNPIEEVRLTVPITDDPSLPVLTFRTWVLGILSCGLLAFLNRFFGFRQNQLTVSSVSAQILV
LPIGKLMAATLPTKKFKCPITNWSFSFNPGPFNIKEHVLITIFASCGASGVYAVHIIAMLRAFYKRSIHPVAALLLALTT
QMLGYGWAGIFRRYLVDSPYMWWPANLVQVSLFRALHEKEKRPKGGLTRIQFFFVVFVSSFAYYIVPGYLFPSLTALSFV
CWIWKRSVTAQQIGSGLSGLGIGAIGIDWSTVSSFLGSPLATPLFAIVNTLVGFALVMYILLPIFYWNNVYEAKRFPIFG
AATFDAQGHKYNVDRVLNKETFDLNVEAYNGYSKLYLSVFFAFTYGLSFATLTASISHVALEDGKSIMEMWMKTKDAVGD
KFADVHTRMMRRNYDSVPGWWFHAVLVVSVALALYACEGFGKVLQLPWWGLLLACLIALGFTLPIGIINATTNQQPGLNV
ITELIIGFLYPGKPVANVVFKTYGYISMAQALAFLSDFKLGHYMKIPPKSMFIVQLVGTVVASSVYFGTAWWLLGSIKDI
CDTAALPEGSPWTCPGDDVFYSASIIWGVIGPGKMFTKEGIYPEMNWCFLIGFLAPVPVWLLSRKFPKKRWIKQIHMPII
IGTASSMPTAKAVHENTWGVVGIFFNYYIYRKYKAWWARHTYILSGALDAGIAFMGVVIYFALQNYDNFGPNWWGLDSGD
HCPLAKCPTAPGVKSKGCPVQ (SEQ ID NO: 33)

>GAY47749.1 hypothetical protein CUMW_106760 [*Citrus unshiu*]
MGSRNFEEDGVPQALSLEKPQTEIKIIGDEEVNDSPIEQVRLTVPITDDPSQPALTFRTWFLGIISCVVLSFLNRFFGFR
QNQLSVGSISAQIIVLPLGKLMAATLPSKPIRVPLTKWTFSMNPGPFNLKEHVLITIFANCGAGGVYAVYIITIVKAFYK
RKLNPLAAMLLAQTTQLLGYGWAGLFRKYLVDSPFMWWPANLVQVSLFRALHEKEKRPKGGLTRLQFFFMVFASSFAYYV
VPGYLFPTLSALSFVCWIWKNSVTAQQIGAGLNGLGIGSFGLDWSTVASFLGSPLASPVFAIINVLAGFILNLYVLVPIA
YWTNTYEAKRFPIFSSHTFDSTGQPYNISRILNEATFDLDHDAFNSYSKLYLSPFFAFNYGLSFATLTATISHVALFDGS
DIWQMWKRTTSAARDKFADVHTRLMKKHYEAVPQWWFHIILVATVALSIYACEGEDKQLQLPWWGILLACAIALFFTLPI
GIIQATTNQQPGLNVITELIIGYMYPGRPLANVAFKTYGYISMSQALSFLADFKLGHYMKIPPKSMFLVQLIGTVVASSV
YFGTAWWLLTSVEHICDPSALPEGSPWTCPGDDVFYSASIIWGIVGPGKMFTKEGVYPALNWFFLVGLLAPVPIWFLSRK
FPEIKWIRLIHIPIIFGGTGNMPPARAVHYLSWAAVGIFFNYYVYRRFKGWWARHTYILSAALDAGVAFMGVFLFLTLQS
YDIFGPHWWGDGEVNDNPIEEVRLTVPITDDPSLPVLTFRTWVLGILSCGLLAFLNRFFGFRQNQLTVSSVSAQILVLPI
GKLMAATLPTKKFKCPITNWSFSFNPGPFNIKEHVLITIFASCGASGVYAVHIIAMLRAFYKRSIHPVAALLLALTTQML
GYGWAGIFRRYLVDSPYMWWPANLVQVSLFRALHEKEKRPKGGLTRIQFFFVVFVSSFAYYIVPGYLFPSLTALSFVCWI
WKRSVTAQQIGSGLSGLGIGAIGIDWSTVSSFLGSPLATPLFAIVNTLVGFALVMYILLPIFYWNNVYEAKRFPIFGAAT
FDAQGHKYNVDRVLNKETFDLNVEAYNGYSKLYLSVFFAFTYGLSFATLTASISHVALFDGKSIMEMWMKTKDAVGDKFA TABLE 3-continued

| Polypeptide sequence of citrus plant negative immune response regulators |
|---|

DVHTRMMRRNYDSVPGWWFHAVLVVSVALALYACEGFGKVLQLPWWGLLLACLIALGFTLPIGIINATTNQQPGLNVITE
LIIGFLYPGKPVANVVFKTYGYISMAQALAFLSDFKLGHYMKIPPKSMFIVQLVGTVVASSVYFGTAWWLLGSIKDICDT
AALPEGSPWTCPGDDVFYSASIIWGVIGPGKMFTKEGIYPEMNWCFLIGFLAPVPVWLLSRKFPKKRWIKQIHMPIIGT
ASSMPTAKAVHFNTWGVVGIFFNYYIYRKYKAWWARHTYILSGALDAGIAFMGVVIYFALQNYDNFGPNWWGLDSGDHCP
LAKCPTAPGVKSKGCPVQ (SEQ ID NO: 34)

>XP_015384626.1 oligopeptide transporter 1-like [*Citrus sinensis*]
MTLYDHDGSVPQSEYSDRHLRISGDGEVNDNPIEEVRLTVPITDDPSLPVLTFRTWVLGILSCGLLAFLNRFFGFRQNQL
TVSSVSAQILVLPIGKLMAATLPTKKFKCPITNWSFSFNPGPFNIKEHVLITIFASCGASGVYAVHIIAMLRAFYKRSIH
PVAALLLALTTQMLGYGWAGIFRRYLVDSPYMWWPANLVQVSLFRALHEKEKRPKGRLTRIQFFFVVFVSSFAYYIVPGY
LFPSLTALSFVCWIWKRSVTAQQIGSGLSGLGIGAIGIDWSTVSSFLGSPLATPLFAIVNTLVGFALVMYILLPIFYWNN
VYEAKRFPIFGAATFDAQGHKYNVDRVLNKETFDLNVEAYNGYSKLYLSVFFAFTYGLSFATLTASISHVALFDGKSIME
MWMKTKDAVGDKFADVHTRMMRRNYDSVPGWWFHAVLVVSVALALYACEGFGKVLQLPWWGLLLACLIALGFTLPIGIIN
ATTNQQPGLNVITELIIGFLYPGKPVANVVFKTYGYISMAQALAFLSDFKLGHYMKIPPKSMFIVQLVGTVVASSVYFGT
AWWLLGSIKDICDTAALPEGSPWTCPGDDVFYSASIIWGVIGPGKMFTKEGIYPEMNWCFLIGFLAPVPVWLLSRKFPKK
RWIKQIHMPIIGTASSMPTAKAVHFNTWGVVGIFFNYYIYRKYKAWWARHTYILSGALDAGIAFMGVVIYFALQNYDNF
GPNWWGLDSGDHCPLAKCPTAPGVKSKGCPVQ (SEQ ID NO: 35)

>XP_024952977.1 oligopeptide transporter 1-like [*Citrus sinensis*]
MGSRNFEEDGVPQALSLEKPQTEIKIIGDEEVNDSPIEQVRLTVPITDDPSQPALTFRTWFLGIISCVVLSFLNRFFGFR
QNQLSVGSISAQIIVLPLGKLMAATLPSKPIRVPLTKWTFSMNPGPFNLKEHVLITIFANCGAGGVYAVYIITIVKAFYK
RKLNPLAAMLLAQTTQLLGYGWAGLFRKYLVDSPFMWWPANLVQVSLFRALHEKEKRPKGGLTRLQFFFMVFASSFAYYV
VPGYLFPTLSALSFVCWIWKNSVTAQQIGAGLNGLGIGSFGLDWSTVASFLGSPLASPVFAIINVLAGFILNLYVLVPIA
YWTNTYEAKRFPIFSSHTFDSTGQPYNISRILNEATFDLDHDAFNSYSKLYLSPFFAFNYGLSFATLTATISHVALFDGS
DIWQMWKRTTSAARDKFADVHTRLMKKHYEAVPQWWFHIILVATVALSIYACEGFDKQLQLPWWGILLACAIALFFTLPI
GIIQATTNQQPGLNVITELIIGYMYPGRPLANVAFKTYGYISMSQALSFLADFKLGHYMKIPPKSMFLVQLIGTVVASSV
YFGTAWWLLTSVEHICDPSALPEGSPWTCPGDDVFYSASIIWGIVGPGKMFTKEGVYPALNWFFLVGLLAPVPIWFLSRK
FPEIKWIRLIHIPIIFGGTGNMPPARAVHYLSWAAVGIFFNYYVYRRFKGWWARHTYILSAALDAGVAFMGVFLFLTLQS
YDIFGPHWWGLDSTDHCPLATCPTAPGIVIEGCPVF (SEQ ID NO: 36)

>XP_024033872.1 oligopeptide transporter 1 [*Citrus clementina*]
MGSRNIEEDGVPQALSLEKPQTEIKIIGDEEVNDSPIEQVRLTVPITDDPSQPALTFRTWFLGIISCVVLSFLNRFFGFR
QNQLSVGSISAQIIVLPLGKLMAATLPSKPIRVPLTKWTFSMNPGPFNLKEHVLITIFANCGAGGVYAVYIITIVKAFYK
RKLNPLAAMLLAQTTQLLGYGWAGLFRKYLVDSPFMWWPANLVQVSLFRALHEKEKRPKGGLTRLQFFFMVFASSFAYYV
VPGYLFPTLSALSFVCWIWKNSVTAQQIGAGLNGLGIGSFGLDWSTVASFLGSPLASPVFAIINVLAGFILNLYVLVPIA
YWTNTYEAKRFPIFSSHTFDSTGQPYNISRILNEATFDLDHDAFNSYSKLYLSPFFAFNYGLSFATLTATISHVALFDGS
DIWQMWKRTTSAARDKFADVHTRLMKKHYEAVPQWWFHIILVATVALSIYACEGFDKQLQLPWWGILLACAIALFFTLPI
GIIQATTNQQPGLNVITELIIGYMYPGRPLANVAFKTYGYISMSQALSFLADFKLGHYMKIPPKSMFLVQLIGTVVASSV
YFGTAWWLLTSVEHICDPSALPEGSPWTCPGDDVFYSASIIWGIVGPGKMFTKEGVYPALNWFFLVGLLAPVPIWFLSRK
FPEIKWIGLIHIPIILGGTGNMPPARAVHYLSWAAVGIFFNYYVYRRFKGWWARHTYILSAALDAGVAFMGVFLFLTLQS
YDIFGPHWWGLDSTDHCPLATCPTAPGIVIEGCPVF (SEQ ID NO: 37)

>XP_024033852.1 oligopeptide transporter 1 [*Citrus clementina*]
MGSYDEDGVTKTKALEKHQTDIDVNGGEEVNDNPIEEVRLTVPITDDPSQPVLTFRTWILGITSCGLLAFVNQFFGYRQN
QLSVGSVSAQILVLPIGKLMAATLPTKQMRVPFTKWSFSLNPGPFNLKEHVLITIFAGCGASGVYAVNIITIVKAFYNRS
LHPVAAMLLVQTTQLLGYGWAGIFRKYLVDSPYMWWPSNLVQVSLFRALHEKERRPKGGLTRLQFFLLVFVSSFGYYIIP
GYLFPSLSALSFVCLIWKDSITAQKLGSGQHGLGIGSFGLDWSTVAGFLGSPLATPFFAIANILAGYFLFLYVLVPIAYW
SNAFEAKKFPLFSSKTFDSDGQVYNITRILNDKAFDLNEIGYRNYSKLYVSVIFAYIYGLSFATLMASISHVALFEGKTI
WEMWKKTATAVNDKFGDVHTRLMKKNYEAVPQWWFQAILVLTFALSLYACEGFGKQLQLPWWGLLLACGMAFFFTLPVGV
IQATTNLQTGLNVITELVIGYMYPGKPLANVTFKTYGYISMSQALSFLGDFKLGHYMKVPPKSMFIVQLVGTLVASTAYF
GTAWWLLTSIDHICNPSLLPEGSPWTCPGDEVFYNASIIWGVVGPLRMFTNYGNYPQMNWFFLIGFLAPFPGWLLSRKFP
EKKWIKNIHMPILLGGPLNLPSAKAVNYTSWAAVGIFFNYYVFRRYKGWWARHNYILSAALDAGVAFMAIMIYFALQSND
IFGPQWWGLDSTDHCPLAKCPIAPGIKADGCPVL (SEQ ID NO: 38)

>XP_006474840.1 oligopeptide transporter 1-like [*Citrus sinensis*]
MGSFDEDGVTKTKALEKHQTDIDVNGGEEVNDNPIEEVRLTVPITDDPSQPVLTFRTWILGITSCGLLAFVNQFFGYRQN
QLSVGSVSAQILVLPIGKLMAATLPTKQMRVPFTKWSFSLNPGPFNLKEHVLITIFAGCGASGVYAVNIITIVKAFYNRS
LHPVAAMLLVQTTQLLGYGWAGIFRKYLVDSPYMWWPSNLVQVSLFRALHEKERRPKGGLTRLQFFLLVFVSSFGYYIIP
GYLFPSLSALSFVCLIWKDSITAQKLGSGQHGLGIGSFGLDWSTVAGFLGSPLATPFFAIANILAGYFLFLYVLVPIAYW
SNAFEAKKFPLFSSKTFDSDGQVYNITRILNDKAFDLNEIGYRNYSKLYVSVIFAYIYGLSFATLMASISHVALFEGKTI
WEMWKKTAAAVNDKFGDVHTRLMKKNYEAVPQWWFQAILVLTFALSLYACEGFGKQLQLPWWGLLLACGMAFFFTLPVGV
IQATTNLQTGLNVITELVIGYMYPGKPLANVTFKTYGYISMSQALSFLGDFKLGHYMKVPPKSMFIVQLVGTLVASTAYF
GTAWWLLTSIDHICNPSLLPEGSPWTCPGDEVFYNASIIWGVVGPLRMFTNYGNYPQMNWFFLIGFLAPFPGWLLSRKFP
EKKWIKNIHMPILLGGPLNLPSAKAVNYTSWAAVGIFFNYYVFRRYKGWWARHNYILSAALDAGVAFMAIMIYFALQSND
IFGPQWWGLDSTDHCPLAKCPIAPGIKADGCPVL (SEQ ID NO: 39)

>GAY47751.1 hypothetical protein CUMW_106770 [*Citrus unshiu*]
MGSFDEDGVTKTKALEKHQTDIDVNGGEEVNDNPIEEVRLTVPITDDPSQPVLTFRTWILGITSCGLLAFVNQFFGYRQN
QLSVGSVSAQILVLPIGKLMAATLPTKQMRVPFTKWSFSLNPGPFNLKEHVLITIFAGCGASGVYAVNIITIVKAFYNRS
LHPVAAMLLVQTTQLLGYGWAGIFRKYLVDSPYMWWPSNLVQVSLFRALHEKERRPTGGLTRLQFFLLVFVSSFGYYIIP
GYLFPSLSALSFVCLIWKDSITAQKLGSGQHGLGIGSFGLDWSTVAGFLGSPLATPFFAIANILAGYFLFLYVLVPIAYW
SNAFEAKKFPLFSSKTFDSDGQVYNITRILNDKAFDLNEIGYRNYSKLYVSVIFAYIYGLSFATLMASISHVALFEGKTI
WEMWKKTAAAVNDKFGDVHTRLMKKNYEAVPQWWFQAILVLTFALSLYACEGFGKQLQLPWWGLLLACGMAFFFTLPVGV
IQATTNLQTGLNVITELVIGYMYPGKPLANVTFKTYGYISMSQALSFLGDFKLGHYMKVPPKSMFIVQLVGTLVASTAYF
GTAWWLLTSIDHICNPSLLPEGSPWTCPGDEVFYNASIIWGVVGPLRMFTNYGNYPQMNWFFLIGFLAPFPGWLLSRKFP
EKKWIKNIHMPILLGGPLNLPSAKAVNYTSWAAVGIFFNYYVFRRYKGWWARHNYILSAALDAGVAFMAIMIYFALQSND
IFGPQWWGLDSTDHCPLAKCPIAPGIKADGCPVL (SEQ ID NO: 40)

TABLE 3-continued

Polypeptide sequence of citrus plant negative immune response regulators

>KDO59179.1 hypothetical protein CISIN_1g004845mg [*Citrus sinensis*]
MEEANDNPIEEVRLTVPITDDPTIPALTFRTWVLGLTSCCLLAFVNQFFGYRQNQLYLSSISAQILVLPIGKLMAATLPS
KPIPVPLTPWSFSLNPGPFNLKEHVLITIFAGCGSSGVYAVGIITIVKAFYKRSLHVVPAMMLVQTTQLLGYGWAGLFRK
YLVDSPYMWWPANLVQVSLFRALHEEEKRTKGGLTRLQFFVIVFISSFAYYVVPGYLFPSISALSFVCWIWKDSVTAQKL
GSGLQGLGMGSFGLDWATVAGFLGSPLATPFFAIANILVGFFLFLYILIPIAYWCNAFEAQRFPLFSSHTFDSDGQIYNV
SRILNEKEFSFDREAYDNYSRLYLSVLFAFIYGLGFATLMASISHVALFEGKTIWQMWRKTTAAVKQQFGDVHTRLMKKN
YEAVPQWWFHAILIITFALSLFTCEGFDKQFQLPWWGLLLACAMAFFFTLPVGVIQATTNLQPGLNIITEMVIGYMYPGK
PLANVAFKTYGYISMVQALGFLGDFKLGHYMKVPPKSMFVVQLVGTIVASTVYFGTAWWLLTSVEHICNPSLLPEGSPWT
CPGDDVFYNASIIWGVVGPLRMFTNYGNYPQMNWFFLIGFLAPFPVWLLSRKFPEKKWIKNIHMPLLLAGPGSLPSAKAV
NYLSWGAVGIFFNYYVYRRFKGWWARHTYILSAALDAGVAFMGVFLYFTLQSQDIFGPEWWGLAATDHCPLAKCPIAPGI
KVQGCPVA (SEQ ID NO: 41)

>XP_006474839.1 oligopeptide transporter 1-like [*Citrus sinensis*]
MRVSHSAMSFTFQFKDRDMGTYVEGGMLQSMSPENSQTDTRTKGDMEEANDNPIEEVRLTVPITDDPTIPALTERTWVLG
LTSCCLLAFVNQFFGYRQNQLYLSSISAQILVLPIGKLMAATLPSKPIPVPLTPWSFSLNPGPFNLKEHVLITIFAGCGS
SGVYAVGIITIVKAFYKRSLHVVPAMMLVQTTQLLGYGWAGLFRKYLVDSPYMWWPANLVQVSLFRALHEEEKRTKGGLT
RLQFFVIVFISSFAYYVVPGYLFPSISALSFVCWIWKDSVTAQKLGSGLQGLGMGSFGLDWATVAGFLGSPLATPFFAIA
NILVGFFLFLYILIPIAYWCNAFEAQRFPLFSSHTFDSDGQIYNVSRILNEKEFSFDREAYDNYSRLYLSVLFAFIYGLG
FATLMASISHVALFEGKTIWQMWRKTTAAVKQQFGDVHTRLMKKNYEAVPQWWFHAILIITFALSLFTCEGFDKQFQLPW
WGLLLACAMAFFFTLPVGVIQATTNLQPGLNIITEMVIGYMYPGKPLANVAFKTYGYISMVQALGFLGDFKLGHYMKVPP
KSMFVVQLVGTIVASTVYFGTAWWLLTSVEHICNPSLLPEGSPWTCPGDDVFYNASIIWGVVGPLRMFTNYGNYPQMNWF
FLIGFLAPFPVWLLSRKEPEKKWIKNIHMPLLLAGPGGLPSAKAVNYLSWGAVGIFFNYYVYRRFKGWWARHTYILSAAL
DAGVAFMGVFLYFTLQSQDIFGPEWWGLAATDHCPLAKCPIAPGIKVQGCPVA (SEQ ID NO: 42)

>XP_006452635.2 oligopeptide transporter 1 [*Citrus clementina*]
MCVSHSAISFTFMFMDRDMGTYVEGGMLQSMSPENSQTDTRTKGDMEEANDNPIEEVRLTVPITDDPTIPALTERTWVLG
LTSCCLLAFVNQFFGYRQNQLYLSSISAQILVLPIGKLMAATLPSKPIPVPLTPWSFSLNPGPFNLKEHVLITIFAGCGS
SGVYAVSIITIVKAFYKRSLHVVPAMMLVHTTQLLGYGWAGLERKYLVDSPYMWWPANLVQVSLFRALHEEEKRTKGGLT
RLQFFVIVFISSFAYYVVPGYLFPSISALSFVCWIWKDSVTAQKLGSGLQGLGMGSFGLDWATVAGFLGSPLATPFFAIA
NILVGFFLFLYILIPIAYWCNAFEAQRFPLFSSHTFDYDGQIYNVSRILNEKEFSFDREAYDNYSRLYLSVLFAFIYGLG
FATLMASISHVALFEGKTIWQMWRKTTAAVKQQFGDVHTRLMKKNYESVPQWWFHAILILTFALSLFTCEGFDKQFQLPW
WGLLLACAMAFFFTLPVGVIQATTNLQPGLNIITEMVIGYMYPGKPLANVAFKTYGYISMVQALGFLGDFKLGHYMKVPP
KSMFVVQLVGTIVASTVYFGTAWWLLTSVEHICNPSLLPEGSPWTCPGDDVFYNASIIWGVVGPLRMFTNYGNYPQMNWF
FLIGFLAPFPVWLLSRKFPEKKWIKNIHMPLLLAGPGSLPSAKAVNYLSWGAVGIFFNYYVYRRFKGWWARHTYILSAAL
DAGVAFMGVFLYFTLQSQGIFGPDWWGLAATDHCPLAKCPIAPGIKVKGCPVA (SEQ ID NO: 43)

>ESR65875.1 hypothetical protein CICLE_v10007550mg [*Citrus clementina*]
MGTYVEGGMLQSMSPENSQTDTRTKGDMEEANDNPIEEVRLTVPITDDPTIPALTFRTWVLGLTSCCLLAFVNQFFGYRQ
NQLYLSSISAQILVLPIGKLMAATLPSKPIPVPLTPWSFSLNPGPFNLKEHVLITIFAGCGSSGVYAVSIITIVKAFYKR
SLHVVPAMMLVHTTQLLGYGWAGLFRKYLVDSPYMWWPANLVQVSLFRALHEEEKRTKGGLTRLQFFVIVFISSFAYYVV
PGYLFPSISALSFVCWIWKDSVTAQKLGSGLQGLGMGSFGLDWATVAGELGSPLATPFFAIANILVGFFLFLYILIPIAY
WCNAFEAQRFPLFSSHTFDYDGQIYNVSRILNEKEFSFDREAYDNYSRLYLSVLFAFIYGLGFATLMASISHVALFEGKT
IWQMWRKTTAAVKQQFGDVHTRLMKKNYESVPQWWFHAILILTFALSLFTCEGFDKQFQLPWWGLLLACAMAFFFTLPVG
VIQATTNLQPGLNIITEMVIGYMYPGKPLANVAFKTYGYISMVQALGFLGDFKLGHYMKVPPKSMFVVQLVGTIVASTVY
FGTAWWLLTSVEHICNPSLLPEGSPWTCPGDDVFYNASIIWGVVGPLRMFTNYGNYPQMNWFFLIGFLAPFPVWLLSRKF
PEKKWIKNIHMPLLLAGPGSLPSAKAVNYLSWGAVGIFFNYYVYRRFKGWWARHTYILSAALDAGVAFMGVFLYFTLQSQ
GIFGPDWWGLAATDHCPLAKCPIAPGIKVKGCPVA (SEQ ID NO: 44)

>ESR65877.1 hypothetical protein CICLE_v10007550mg [*Citrus clementina*]
MEEANDNPIEEVRLTVPITDDPTIPALTFRTWVLGLTSCCLLAFVNQFFGYRQNQLYLSSISAQILVLPIGKLMAATLPS
KPIPVPLTPWSFSLNPGPFNLKEHVLITIFAGCGSSGVYAVSIITIVKAFYKRSLHVVPAMMLVHTTQLLGYGWAGLFRK
YLVDSPYMWWPANLVQVSLFRALHEEEKRTKGGLTRLQFFVIVFISSFAYYVVPGYLFPSISALSFVCWIWKDSVTAQKL
GSGLQGLGMGSFGLDWATVAGFLGSPLATPFFAIANILVGFFLFLYILIPIAYWCNAFEAQRFPLFSSHTFDYDGQIYNV
SRILNEKEFSFDREAYDNYSRLYLSVLFAFIYGLGFATLMASISHVALFEGKTIWQMWRKTTAAVKQQFGDVHTRLMKKN
YESVPQWWFHAILILTFALSLFTCEGFDKQFQLPWWGLLLACAMAFFFTLPVGVIQATTNLQPGLNIITEMVIGYMYPGK
PLANVAFKTYGYISMVQALGFLGDFKLGHYMKVPPKSMFVVQLVGTIVASTVYFGTAWWLLTSVEHICNPSLLPEGSPWT
CPGDDVFYNASIIWGVVGPLRMFTNYGNYPQMNWFFLIGFLAPFPVWLLSRKFPEKKWIKNIHMPLLLAGPGSLPSAKAV
NYLSWGAVGIFFNYYVYRRFKGWWARHTYILSAALDAGVAFMGVFLYFTLQSQGIFGPDWWGLAATDHCPLAKCPIAPGI
KVKGCPVA (SEQ ID NO: 45)

YSL6 protein Sequences

>XP_006423237.2 probable metal-nicotianamine transporter YSL6 isoform X1 [*Citrus clementina*]
METAFSASMGTEVEVSEPLIEKITAEEDQLIPEWKDQITIRGLAVSAIMGTLFCIITHRLNLTVGIIPSLNIAAGLIGFL
SVKSWTSFLSKLGFSTKPFTRQENTVIQTCVVACYGLAASGGFGSSFLAMDKRTYKLIGTEYPGNRAEDVKNPGLGWMIV
FMFVVSFVGLFSLVALRKVMILDGKLTYPSGTATAVLINGFHTNAGAELAGMQVRCIGKYLSISFLCSSFKWFFSGVGDS
CGFDNFPSFGLILFKNTFYFDFSPTYVGCGLICPRIVNCSVLLGAIVSWGFLWPYISQHAGDWYPADLGNSDFKGLYGYK
VFIAISLILGDGLYNLIKIISVTFKELCNKRTKVSKLPIDNEIQDTESSRLLIDQKKRENVFLKDGIPTWFAASGYVGLA
AISTATIPTIFPPLKWYLVLLLYLIAPALAFCNSYGAGLTDCSLSLTYAKIGLFIIASLVGTNGGVIAGLAACGVMMSIV
STAADLMQDFKTGYLTLSSAKSMFVSQLLGTAMGCVFAPLTFWMYWTAFDIGSPDGPYKAPYAVILREMAILGIEGFSEL
PKHCLALCCGFFVAALVINLLRDVIPEKISKFIPVPMAMAIPFFVGAYLAIDMFVGTVILFIWERINRKDSEDYAGAVAS
GLICGDGIWTMPSAVLSIFSINPPICMYFGPTVSS (SEQ ID NO: 46)

>ESR36477.1 hypothetical protein CICLE_v10027961mg [*Citrus clementina*]
MGTEVEVSEPLIEKITAEEDQLIPEWKDQITIRGLAVSAIMGTLFCIITHRLNLTVGIIPSLNIAAGLLGFLSVKSWTSF
LSKLGFSTKPFTRQENTVIQTCVVACYGLAASGGFGSSFLAMDKRTYKLIGTEYPGNRAEDVKNPGLGWMIVFMFVVSFV
GLFSLVALRKVMILDGKLTYPSGTATAVLINGFHTNAGAELAGMQVRCIGKYLSISFLCSSFKWFFSGVGDSCGFDNFPS TABLE 3-continued

| Polypeptide sequence of citrus plant negative immune response regulators |
| --- |
| FGLILFKNTFYFDFSPTYVGCGLICPRIVNCSVLLGAIVSWGFLWPYISQHAGDWYPADLGNSDFKGLYGYKVFIAISLI LGDGLYNLIKIISVTFKELCNKRTKVSKLPIDNEIQDTESSRLLIDQKKRENVELKDGIPTWFAASGYVGLAAISTATIP TIFPPLKWYLVLLLYLIAPALAFCNSYGAGLTDCSLSLTYAKIGLFIIASLVGTNGGVIAGLAACGVMMSIVSTAADLMQ DFKTGYLTLSSAKSMFVSQLLGTAMGCVFAPLTFWMYWTAFDIGSPDGPYKAPYAVILREMAILGIEGESELPKHCLALC CGFFVAALVINLLRDVIPEKISKFIPVPMAMAIPFFVGAYLAIDMFVGTVILFIWERINRKDSEDYAGAVASGLICGDGI WTMPSAVLSIFSINPPICMYFGPTVSS (SEQ ID NO: 47) |
| >GAY65240.1 hypothetical protein CUMW_239690 [*Citrus unshiu*] METAFSASMGTEVEVSEPLIEKITAEEDQLIPEWKDQITIRGLAVSAIMGTLFCIITHRLNLTVGIIPSLNIAAGLLGFL SVKSWTSFLSKLGFSTKPFTRQENTVIQTCVVAFMASLLAFDVIINMQLSTGGFGSSFLAMDERTYKLIGTEYPGNRAED VKNPGLGWMIVFMFVVSFVGLFSLVALRKVMILDGKLTYPSGTATAVLINGFHTNAGAELAGMQVRCIGKYLSISFLCSS FKWFFSGVGDSCGFDNFPSFGLILFKNTFYFDFSPTYVGCGLICPRIVNCSVLLRAIVSWGFLWPYISQHAGDWYPADLG NSDFKGLYGYKVFIAISLILGDGLYNLIKIISVTFKELCNKRTKVSKLPIDNEIQDTESSRLLIEQKKRENVFLKDGIPT WFAASGYVGLAAISTATIPTIFPPLKWYLVLLLYLIAPALAFCNSYGAGLTDCSLSLTYAKIGLFIIASLVGTNGGVIAG LAACGVMMSIVSTAADLMQDFKTGYLTLSSAKSMFVSQLLGTAMGCVFAPLTFWMYWTAFDIGSPDGPYKAPYAVILREM AILGIEGFSELPKHCLALCCGFFVAALVINLLRDVIPEKISKFIPVPMAMAIPFFVGAYLAIDMFVGTVILFIWERINRK DSEDYAGAVASGLICGDGIWTMPSAVLSIFSINPPICMYFGPTVSS (SEQ ID NO: 48) |
| >XP_006447029.1 probable metal-nicotianamine transporter YSL6 [*Citrus clementina*] MGTEVEVSEPLIEKIAAVNDEEEEADQPIPEWKDQITIRGLVASAIMGTLFCIITHKLNLTVGIIPSLNVAAGLLGFFLV KSWTSFLSKLGFSIKPFTRQENTVIQTCVVACYGLAFSGGFGSSLLAMDERTYQLIGADYPGNRAEDVKNPGLGWMIGFV VVVSFLGLFSLVPLRKVMILDYKLTYPSGTATAMLINSFHTNTGAELAGKQVRCLGKYLSISFFWSCFKWFFSGVGNSCG FDNFPSFGLTLFKNTFYFDFSPTYVGCGLICPHIVNCSVLLGAIISWGFLWPFISQHAGDWYPADLGSNDFKGLYGYKVF IAISLILGDGLYNLIKIITITVKEMWNRSTKDSKLPFVNDIQDTETSKLLLEQKKREIVELKDGIPTWFAASGYVGLAAI STATIPTIFPPLKWYLVLCSYLIAPALAFCNSYGTGLTDWNLASTYGKIGLFIIASLVGTDGGVIAGLAACGVMMSIVST AADLMQDFKTGYLTLSSAKSMFVSQLLGTAMGCVIAPLTFWMYWTAFDIGSPDGPYKAPYAVIFREMAILGIEGFSELPK HCLALCCGFFVAALVINLLRDATPTKISQFIPVPMAMAVPFYIGAYFAIDMFVGTVILFIWELVNRKDSEDYAGAVASGL ICGDGIWTIPSAILSIFRVNPPVCMYFGPAVGS (SEQ ID NO: 49) |
| >KDO63888.1 hypothetical protein CISIN_1g005868mg [*Citrus sinensis*] MGTEVEVSEPLIEKIAAVNDEEEEADQPIPEWKDQITIRGLVASAIMGTLFCIITHKLNLTVGIIPSLNVAAGLLGFFLV KSWTSFLSKLGFSIKPFTRQENTVIQTCVVACYGLAFSGGFGSSLLAMDERTYQLIGADYPGNRAEDVKNPGLGWMIGFV VVVSFLGLFSLVPLRKVMILDYKLTYPSGTATAMLINSFHTNTGAELAGKQVRCLGKYLSISFFWSCFKWFFSGVGNSCG FDNFPSFGLTLFKNTFYFDFSPTYVGCGLICPHIVNCSVLLGAIISWGFLWPFISQHAGDWYPADLGSNDFKGLYGYKVF IAISLILGDGLYNLIKIITITVKEMWNRSTKDSKLPFVNDIQDTETSKLLLEQKEREIVFLKDGIPTWFAASGYVGLAAI STATIPTIFPPLKWYLVLCSYLIAPALAFCNSYGTGLTDWNLASTYGKIGLFIIASLVGTDGGVIAGLAACGVMMSIVST AADLMQDFKTGYLTLSSAKSMFVSQLLGTAMGCVIAPLTFWMYWTAFDIGSPDGPYKAPYAVIFREMAILGIEGFSELPK HCLALCCGFFVAALVINLLRDATPTKISRFIPVPMAMAVPFYIGAYFAIDMFVGTVILFIWELVNRKDSEDYAGAVASGL ICGDGIWTIPSAILSIFRVNPPVCMYFGPAVGS (SEQ ID NO: 50) |
| >GAY57997.1 hypothetical protein CUMW_183700 [*Citrus unshiu*] MGTEVEVSEPLIEKIAAVNDEEEEADQPIPEWKDQITIRGLVASAIMGTLFCIITHKLNLTVGIIPSLNVAAGLLGFFLV KSWTSFLSKLGFSIKPFTRQENTVIQTCVVACYGLAFSGGFGSSLLAMDERTYQLIGADYPGNRAEDVKNPGLGWMIGFV VVVSFLGLFSLVPLRKVMILDYKLTYPSGTATAMLINSFHTNTGAELAGKQVRCLGKYLSISFFWSCFKWFFSGVGNSCG FDNFPSFGLTLFKNTFYFDFSPTYVGCGLICPHIVNCSVLLGAIISWGFLWPFISQHAGDWYPADLGSNDFKGLYGYKVF IAISLILGDGLYNLIKIIAITVKEMWNRSTKDSKLPFVNDIQDTETSKLLLEQKKREIVFLKDGIPTWFAASGYVGLAAI STATIPTIFPPLKWYLVLCSYLIAPALAFCNSYGTGLTDWNLASTYGKIGLFIIASLVGTDGGVIAGLAACGVMMSIVST AADLMQDFKTGYLTLSSAKSMFVSQLLGTAMGCVIAPLTFWMYWTAFDIGSPDGPYKAPYAVIFREMAILGIEGFSELPK HCLALCCGFFVAALVINLLRDATPTKISQFIPVPMAMAVPFYIGAYFAIDMFVGTVILFIWELVNQKDSEDYAGAVASGL ICGDGIWTIPSAILSIFRVNPPVCMYFGPAVGS (SEQ ID NO: 51) |
| >GAY65241.1 hypothetical protein CUMW_239690 [*Citrus unshiu*] MGTEVEVSEPLIEKITAEEDQLIPEWKDQITIRGLAFDVIINMQLSTGGFGSSFLAMDERTYKLIGTEYPGNRAEDVKNP GLGWMIVFMFVVSFVGLESLVALRKVMILDGKLTYPSGTATAVLINGFHTNAGAELAGMQVRCIGKYLSISFLCSSFKWF FSGVGDSCGFDNFPSFGLILFKNTFYFDFSPTYVGCGLICPRIVNCSVLLRAIVSWGFLWPYISQHAGDWYPADLGNSDF KGLYGYKVFIAISLILGDGLYNLIKIISVTFKELCNKRTKVSKLPIDNEIQDTESSRLLIEQKKRENVFLKDGIPTWFAA SGYVGLAAISTATIPTIFPPLKWYLVLLLYLIAPALAFCNSYGAGLTDCSLSLTYAKIGLFIIASLVGTNGGVIAGLAAC GVMMSIVSTAADLMQDFKTGYLTLSSAKSMFVSQLLGTAMGCVFAPLTFWMYWTAFDIGSPDGPYKAPYAVILREMAILG IEGFSELPKHCLALCCGFFVAALVINLLRDVIPEKISKFIPVPMAMAIPFFVGAYLAIDMFVGTVILFIWERINRKDSED YAGAVASGLICGDGIWTMPSAVLSIFSINPPICMYFGPTVSS (SEQ ID NO: 52) |
| >GAY65242.1 hypothetical protein CUMW_239690 [*Citrus unshiu*] MQLSTGGFGSSFLAMDERTYKLIGTEYPGNRAEDVKNPGLGWMIVFMFVVSFVGLFSLVALRKVMILDGKLTYPSGTATA VLINGFHTNAGAELAGMQVRCIGKYLSISFLCSSFKWFFSGVGDSCGFDNFPSFGLILFKNTFYFDFSPTYVGCGLICPR IVNCSVLLRAIVSWGFLWPYISQHAGDWYPADLGNSDFKGLYGYKVFIAISLILGDGLYNLIKIISVTFKELCNKRTKVS KLPIDNEIQDTESSRLLIEQKKRENVFLKDGIPTWFAASGYVGLAAISTATIPTIFPPLKWYLVLLLYLIAPALAFCNSY GAGLTDCSLSLTYAKIGLFIIASLVGTNGGVIAGLAACGVMMSIVSTAADLMQDFKTGYLTLSSAKSMFVSQLLGTAMGC VFAPLTFWMYWTAFDIGSPDGPYKAPYAVILREMAILGIEGFSELPKHCLALCCGFFVAALVINLLRDVIPEKISKFIPV PMAMAIPFFVGAYLAIDMFVGTVILFIWERINRKDSEDYAGAVASGLICGDGIWTMPSAVLSIFSINPPICMYFGPTVSS (SEQ ID NO: 53) |
| >XP_006487169.1 probable metal-nicotianamine transporter YSL6 isoform X2 [*Citrus sinensis*] MDKRTYKLIGTEYPGNRAEDVKNPGLGWMIVFMFVVSFVGLFSLVALRKVMILDGKLTYPSGTATAVLINGFHTNAGAEL AGMQVRCIGKYLSISFLCSSFKWFFSGVGDSCGFDNFPSFGLILFKNTFYFDFSPTYVGCGLICPRIVNCSVLLGAIVSW GFLWPYISQHAGDWYPADLGNSDFKGLYGYKVFIAISLILGDGLYNLIKIISVTFKELCNKRTKVSKLPIDNEIQDTESS RLLIDQKKRENVFLKDGIPTWFAASGYVGLAAISTATIPTIFPPLKWYLVLLLYLIAPALAFCNSYGAGLTDCSLSLTYA |

TABLE 3-continued

Polypeptide sequence of citrus plant negative immune response regulators

KIGLFIIASLVGTNGGVIAGLAACGVMMSIVSTAADLMQDFKTGYLTLSSAKSMFVSQLLGTAMGCVFAPLTFWMYWTAF
DIGSPDGPYKAPYAVILREMAILGIEGFSELPKHCLALCCGFFVAALVINLLRDVIPEKISKFIPVPMAMAIPFFVGAYL
AIDMFVGTVILFIWERINRKDSEDYAGAVASGLICGDGIWTMPSAVLSIFSINPPICMYFGPTVSS (SEQ ID NO:
54)

>ESR60268.1 hypothetical protein CICLE_v10014497mg [*Citrus clementina*]
MDPMSFCLHFIFLVIELLEFDVIMDTQLPSGGFGSSLLAMDERTYQLIGADYPGNRAEDVKNPGLGWMIGFVVVVSFLGL
FSLVPLRKVMILDYKLTYPSGTATAMLINSFHTNTGAELAGKQVRCLGKYLSISFFWSCFKWFFSGVGNSCGFDNFPSFG
LTLFKNTFYFDFSPTYVGCGLICPHIVNCSVLLGAIISWGFLWPFISQHAGDWYPADLGSNDFKGLYGYKVFIAISLILG
DGLYNLIKIITITVKEMWNRSTKDSKLPFVNDIQDTETSKLLLEQKKREIVFLKDGIPTWFAASGYVGLAAISTATIPTI
FPPLKWYLVLCSYLIAPALAFCNSYGTGLTDWNLASTYGKIGLFIIASLVGTDGGVIAGLAACGVMMSIVSTAADLMQDF
KTGYLTLSSAKSMFVSQLLGTAMGCVIAPLTFWMYWTAFDIGSPDGPYKAPYAVIFREMAILGIEGFSELPKHCLALCCG
FFVAALVINLLRDATPTKISQFIPVPMAMAVPFYIGAYFAIDMFVGTVILFIWELVNRKDSEDYAGAVASGLICGDGIWT
IPSAILSIFRVNPPVCMYFGPAVGS (SEQ ID NO: 55)

>KDO63889.1 hypothetical protein CISIN_1g005868mg [*Citrus sinensis*]
MIGLFILLGINFSFFSSVLYQVMILDYKLTYPSGTATAMLINSFHTNTGAELAGKQVRCLGKYLSISFFWSCFKWFFSGV
GNSCGFDNFPSFGLTLFKNTFYFDFSPTYVGCGLICPHIVNCSVLLGAIISWGFLWPFISQHAGDWYPADLGSNDFKGLY
GYKVFIAISLILGDGLYNLIKIITITVKEMWNRSTKDSKLPFVNDIQDTETSKLLLEQKEREIVELKDGIPTWFAASGYV
GLAAISTATIPTIFPPLKWYLVLCSYLIAPALAFCNSYGTGLTDWNLASTYGKIGLFIIASLVGTDGGVIAGLAACGVMM
SIVSTAADLMQDFKTGYLTLSSAKSMFVSQLLGTAMGCVIAPLTFWMYWTAFDIGSPDGPYKAPYAVIFREMAILGIEGF
SELPKHCLALCCGFFVAALVINLLRDATPTKISRFIPVPMAMAVPFYIGAYFAIDMFVGTVILFIWELVNRKDSEDYAGA
VASGLICGDGIWTIPSAILSIFRVNPPVCMYFGPAVGS (SEQ ID NO: 56)

> PtYSL6_ Ptrif.0002s1042.2_ *Poncirus_trifoliata*
MGTEVEVSEPLIENIAAVNDEEEEADQPIPEWKDQITIRGLVASAIMGTL
FCIITHKLNLTVGIIPSLNVAAGLLGFFLVKSWTSFLSKLGFSIKPFTRQ
ENTVIQTCVVACYGLAFSGGFGSSLLAMDERTYQLIGADYPGNRAEDVKN
PGLGWMIGFLVVVSFLGLFSLVPLRKVMILDYKLTYPSGTATAMLINSFH
TNTGAELAGKQVRCLGKYLSISFFWSCFKWFFSGVGNSCGFDNFPSFGLT
LFKNTFYFDFSPTYVGCGLICPHIVNCSVLLGAIISWGLLWPFISQHAGD
WYSADLGSNDFKGLYGYKVFIAISLILGDGLYNLIKIIAITVKEMWNRST
KDSKLPIVNDIQDTETSKLLLEQKKREIVELKDGIPTWFAASGYVGLAAI
STATIPIIFPPLKWYLVLCSYLIAPALAFCNSYGTGLTDWSLASTYGKIG
LFIIASLVGTDGGVIAGLAACGVMMSIVSTAADLMQDFKTGYLTLSSAKS
MFVSQLLGTAMGCVIAPLTFWMYWTAFDIGSPDGPYKAPYAVIFREMAIL
GIEGFSELPKHCLALCCGFFVAALVINLLRDVTPTKISQFIPVPMAMAVP
FYIGAYFAIDMFVGTVILFIWELVNRKDSEDYAGAVASGLICGDGIWTIP
SAILSIFRVNPPICMYFGPAVGS- (SEQ ID NO: 57)

PUB26 protein sequences
>PtPUB26_Ptrif.0008s0466.1_*Poncirus_trifoliata*
MPGSLEPLDLSVQIPYHFRCPISLELMCDPVTVCTGQTYDRPSIESWVAT
GNTTCPVTRSPLTDFTLIPNHTLRRLIQDWCVANRSFGVQRIPTPKQPAE
PSLVRTLLSQASSESNTYGSRLSALRRLRGLARDSDKNRSLISSHNVRAV
LSQVFFTNINVNTASSPELAHESLALLVMFPLTETECMEIASDADKITSL
SSLLFHSSIEVRVNSAALIEIVLAGMRSQELRTQISNVDEIFEGVIDILK
NLSSYPRGLKVGIKALFALCLVKQTRHKAVAAGAAETLVDRLADFDKCDA
ERALATVELLCRIPAGCAAFAEHALTVPLLVKTILKISDRATEYAAGALA
ALCSASERCQRDAVSAGVLTQLLLLVQSDCTDRAKRKAQLLLKLLRDSWP
QDSIGNSDDFACSEVVPF- (SEQ ID NO: 58)

>CcPUB26_XP_006422990.1_*Citrus_clementina*
MPGSLEPLDLSVQIPYHFRCPISLELMCDPVTVCTGQTYDRPSIESWVATGNTTCPVTRSPLTDFTLIPNHTLRRLIQDW
CVANRSFGVQRIPTPKQPAEPSLVRTLLNQASSESNTYGSRMSALRRLRGLARDSDKNRCLISSHNVRAILSQVFFTNIN
VNTASSPELAHESLALLVMFPLTETECMEIASDADKITSLSSLLFHSSIEVRVNSAALIEIVLAGMRSQELRAQISNLDE
IFEGVIDILKNLSSYPRGLKVGIKALFALCLVKQTRHKAVAAGAAETLVDRLADFDKCDAERALATVELLCRIPAGCAEF
AEHALTVPLLVKTILKISDRATEYAAGALAALCSASERCQRDAVSAGVLTQLLLLVQSDCTDRAKRKAQLLLKLLRDSWP
QDSIGNSDDFACSEVVPF (SEQ ID NO: 59)

>CsPUB26_XP_006487052.1_*Citrus_sinensis*
MPGSLEPLDLSVQIPYHFRCPISLELMCDPVTVCTGQTYDRPSIESWVATGNTTCPVTRSPLTDFTLIPNHTLRRLIQDW
CVANRSFGVQRIPTPKQPAEPSLVRTLLNQASSESNTYGSRLSALRRLRGLARDSDKNRSLISSHNVRAILSQVFFTNIN
VKTASSPELAHESLALLVMFPLTETECMEIASDADKITSLSSLLFHSSIEVRVNSAALIEIVLAGMRSQELRAQISNLDE
IFEGVIDILKNLSSYPRGLKVGIKALFALCLVKQTRYKAVAAGAAETLVDRLADFDKCDAERALATVELLCRIPAGCAEF
AEHALTVPLLVKTILKISDRATEYAAGALAALCSASERCQRDAVSAGVLTQLLLLVQSDCTDRAKRKAQLLLKLLRDSWP
QDSIGNSDDFACSEVVPF (SEQ ID NO: 60)

>CiPUB26_Ci252440_*Citrus_ichangensis*
MPGSLEPLDLSVQIPYHFRCPISLELMCDPVTVCTGQTYDRPSIESWVAT
GNTTCPVTRSPLTDFTLIPNHTLRRLIQDWCVANRSFGVQRIPTPKQPAE
PSLVRTLLNQASSESNTYGSRLSALRRLRGLARDSDKNRSLISSHNVRAI
LSQVFFTNINVNTASSPELAHESLALLVMFPLTETECMEIASDADKITSL
SSLLFHSSIEVRVNSAALIEIVLAGMRSQELRAQISNLDEIFEGVIDILK
NLSSYPRGLKVGIKALFALCLVKQTRHKAVAAGAAETLVDRLADFDKCDA
ERALATVELLCRIPAGCAEFAEHALTVPLLVKTILKISDRATEYAAGALA
ALCSASERCQRDAVSAGVLTQLLLLVQSDCTDRAKRKAQLLLKLLRDSWP
QDSIGNSDDFACSEVVPF- (SEQ ID NO: 61)

TABLE 3-continued

| Polypeptide sequence of citrus plant negative immune response regulators |
|---|

>CrPUB26_MSYJ246190.1_*Citrus_reticulata*
MPGSLEPLDLSVQIPYHFRCPISLELMCDPVTVCTGQTYDRPSIESWVAT
GNTTCPVTRSPLTDFTLIPNHTLRRLIQDWCVANRSFGVQRIPTPKQPAE
PSLVRTLLNQASSESNTYGSRLSALRRLRGLARDSDKNRSLISSHNVRAI
LSRVFFTNINVNTASSPELAHESLALLVMFPLTETECMEIASDADKITSL
SSLLFHSSIEVRVNSAALIEIVLAGMRSQELRAQIMRRGEGAGDGGVTVQ
DPGGLRRVCGARADGAAAGEDDTEDIGQGDGVRGGGAGGAVLGVGEVPEG
RGQRGGVDPAVAVGAERLYGQGQEEGAAAVEATEGEVASGFYWEFR- (SEQ ID NO: 62)

>CmaPUB26_Cg8g004360.1_*Citrus_maxima*
MPGSLEPLDLSVQIPYHFRCPISLELMCDPVTVCTGQTYDRPSIESWVAT
GNTTCPVTRSPLTDFTLIPNHTLRRLIQDWCVANRSFGVQRIPTPKQPAE
PSLVRTLLNQASSESNTYGSRLSALRRLRGLARDSDKNRSLISSHNVRAI
LSQVFFTNINVKTASSPELAHESLALLVMFPLTETECMEIASDADKITSL
SSLLFHSSIEVRVNSAALIEIVLAGMRSQELRAQISNLDEIFEGVIDILK
NLSSYPRGLKVGIKALFALCLVKQTRYKAVAAGAAETLVDRLADFDKCDA
ERALATVELLCRIPAGCAEFAEHALTVPLLVKTILKISDRATEYAAGALA
ALCSASERCQRDAVSAGVLTQLLLLVQSDCTDRAKRKAQLLLKLLRDSWP
QDSIGNSDDFACSEVVPF- (SEQ ID NO: 63)

> CmePUB26_Cm188050.1_*Citrus_medica*
MPGSLEPLDLSVQIPYHFRCPISLELMCDPVTVCTGQTYDRPSIESWVAT
GNTTCPVTRSPLTDFTLIPNHTLRRLIQDWCVANRSFGVQRIPTPKQPAE
PSLVRTLLNQASSESNTYGSRLSALRRLRGLARDSDKNRSLISSHNVRAI
LSQVFFTNINVNTASSSPELAHESLALLVMFPLTETECMEIASDADKITS
LSSLLFHSSIEVRVNSAALIEIVLAGMRSQELRAQISNVDEIFEGVIDIL
KNLSSYPRGLKVGIKALFALCLVKQTRQKAVAAGAAETLVDRLADFDKCD
AERALATVELLCRIPAGCAAFAEHALTVPLLVKTILKISDRATEYAAGAL
VALCSASERCQRDAVSAGVLTQLLLLVQSDCTDRAKRKAQLLLKLLRDSW
PQDSIGNSDDFACSEVVPF- (SEQ ID NO: 64)

>SlPUB26_Solyc01g107980.2 sequence match in blast db Tomato Genome protein sequences (ITAG release 2.40)
MPASLDPLDVGVQIPYHFRCPISLELMRDPVTVCTGQTYDRQSIESWVATGNTTCPVTRAPLSDFTLIPNHTLRRLIQEW
CVANRAFGVERIPTPKQPADPSLVRSLLNQAAAQSNHMNSRVAALRRLRGLARDSEKNRSVISANNAREILLAIVFSRMD
SDASELHHESLAILSMFPLSEPECVFVASDPGRVGYLVAMLFHPSIDVRVNSAALIETVVAGMRSPEFRAQISNADDVFE
GVVGILNYPLAYPRALKVGIKALFALCLVKQHRQRAVSAGAVEALIDRLQDFEKCDAERALATIELLSRIPSGCAALASH
ALTVPLLVKIILKISERATEYAAGALLSLCSASEQAQKEAVAAGVLIQLLLLVQSDCTERAKRKAQMLLKQLRDCWPEDS
IANTDDFACSDVVPF (SEQ ID NO: 65)

>SlPUB26_KAH0727421.1 hypothetical protein KY284-003286 [*Solanum tuberosum*]
MPGSLDPLDVGVQIPYHFRCPISLELMRDPVTVCTGQTYDRQSIESWVATGNTTCPVTRAPLSDFTLIPN
HTLRRLIQEWCVANRAFGVERIPTPKQPADPSLVRSLLNQAAAQSNHMNSRVAALRRLRGLARDSDKNRS
VILANNAREILLAIVFSRMDSDSSELNHESLAILSMFPLSEPECVFVASDPERVSYLVAMLFHPSIDVRV
NSAALIEIVVAGMRSPELRAQISNADDVFEGIVGILNYPLAYPRALKVGIKALFALCLVKQHRQRAVTAG
AVEALIDRLQDFEKCDAERALATIELLSRIPSGCAALASHALTVPLLVKIILKISERATEYAAGALLSLC
SASEQAQKEAVAAGVLIQLLLLVQSDCTERAKRKAQMLLKQLRDCWPEDSIANSDDFACSDVVPF (SEQ ID NO: 66)

| DMR6 protein Sequences |
|---|

>PtDMR6.1_Ptrif.0007s1480.1.v1.3.1_*Poncirus_trifoliata*_v1.3.1
MAAAAITHIKLLLSDLASTLKNVPSDYIRPISDRPNPTDQAHISDGSIPL
IDLQGLNGPRRSDIIKQIGQACQHGGFFQVKNHGISEAMINNMLSIARTF
FKLPERERLKIYSDDPLKPTRLSTGFNVKTEKASNRRDFLRLHCYPLQDY
VHDWPLNPPSFREDVGDYCASVRGLVLRLIEAISESLRLPSDYIDKEALG
KQGQHMALNYYPPCPPPELTYGLPGHTDPNLITIHRAVVSRDKERTLVPI
IAQNLHLIADVDNEGAGNRIYRNTFAVSEDLQSRDIILKKNSY- (SEQ ID NO: 67)

> PtDMR6.2_Ptrif.0007s1482.2.v1.3.1_*Poncirus_trifoliata*_v1.3.1
MSAAATTATKLLLSDLAPTLTNVPSDYIRPISDRPSFTDQTHKSDGSIPL
IDLQGLNGPRRSDIIKQIGQACQHCGFFQVKNHGISEAMINNMLSIARTF
FKLPESERLKIYSDDPSKPTRLSTSFNVKTEKLSNWRDFLRLHCYPLQDY
VHDWPLNPPSFREDVGDYCTSVRGLVLRLIEAISETLGLPSDYIDKEALG
KHGQHMALNYYPPCPQPELTYGLPGHTDPNLITILLQDDVPGLQVLRDGN
WVPVNPIPSTFIVNIGDQMQVLSNDRYKSVLHRAVVSRDKERISIPTFYC
PSPYAVIGPAKGLVDQDHPAVYRDFTYAEYYKKFWNRGLATECCLDMFKA
SSTV- (SEQ ID NO: 68)

> PtDMR6.3_Ptrif.0009s1899.1.v1.3.1_*Poncirus_trifoliata*_v1.3.1
MQLMHRLCIVMRSDSHRLSVNGDEITILISKYNQALRYRPLDMAAATTKL
LLSDLASTVKSVPSNYIRPISDRPNLTEVQISDGSIPLIDLQVLDGPRRL
DIIKQIGQACQHDGFFQVKNHGIPETIINNMLSIARAFFKLPESERLKSY
SDDPSKSTRLSTSFNVNTEKVANWRDYLRLHCYPLQDYIHEWPSTPPSVR TABLE 3-continued Polypeptide sequence of citrus plant negative immune response regulators EVAAEYCTSLRGLVLRLLEAISESLGLQRDFIDKALGKHGQHMALNYYPP
CPQPDLTYGLPGHTDPNLITVLLQDDVPGLQVLRNGKWLPVGPIPNTFIV
NIGDQMQVLSNDRYKSVLHRALVNCDKERISIPTFYCPSPDAVIAPAKDL
IDERHPAVYKNFTYAEYYRKFWNRGLDERCLDLFKASTA- (SEQ ID NO: 69)

> PtDMR6.4_Ptrif.0009s1896.1.v1.3.1_*Poncirus_trifoliata*_v1.3.1
MQLVHQFMRPDGHRLSVNSDEITILSSKYNQALRYRPLDIAAATTKLLLS
DLASTVKSVPSNYIRPISDRPNLTEVQISDGSIPLIDLQVLNGPRRLDLI
KQIRQACQHDGFFQVKNHEIPETIINNMLSIARAFFKLPESERLKSYSDD
PSKSTRLSTSFNVNTEKVANWRDYLRLYYYPLQDYMHEWPSNPPSFREVV
TEYYTSVRGLVPKLLEAISESLGVQRDNVDKALGKHGQHMALNYCPPCPQ
PDLTYELPRHTDPNLITVLLQDDVPGLQLLRNGKWLPGSPIPNTFIVNIG
DQMQVLSNDLYKSVLHRALVSCDKERISIPTFYCPSLDAVIAPTKDLIDE
RHLAFYKNFTYAEYYQKF- (SEQ ID NO: 70)

>ESR40545.1 hypothetical protein CICLE_v10027096mg [*Citrus clementina*]
MAAAATTHIKLLLSDLASTLQNVPSDYIRPISDRPNLTDQAHISDGSIPLIDLQGLYGPRRSDIIKQIGQACQHGGFFQV
KNHGISEAMINNMLSIARTFFKLPERERLKNYSDDPLKPTRLSTSFNVKTEKASNRRDFLRLHCYPLQDYVHDWPLNPPS
FREDVGDYCTSVRGLVLRLIEAISESLRLPSDYIDKEALGKHGQHMALNYYPPCPPPELTYGLPGHTDPNLITIHRAVVS
RDKERTLVPIIAENLHLIADVDNEGLIDQDHPAVYRDFTYAEYYEKFWNRGLAAECRLDMEKAS (SEQ ID NO: 71)

>XP_024036895.1 protein DMR6-LIKE OXYGENASE 2 [*Citrus clementina*]
MAAAATTHIKLLLSDLASTLQNVPSDYIRPISDRPNLTDQAHISDGSIPLIDLQGLYGPRRSDIIKQIGQACQHGGFFQV
KNHGISEAMINNMLSIARTFFKLPERERLKNYSDDPLKPTRLSTSFNVKTEKASNRRDFLRLHCYPLQDYVHDWPLNPPS
FREDVGDYCTSARGFVTGKMWVTTVQVLEGWC (SEQ ID NO: 72)

>GAY54543.1 hypothetical protein CUMW_157480 [*Citrus unshiu*]
MPSMHQHECFFQVKNHGISEAMINNMLSIARTFFNLPERERLKIYSDDPLKPTRLSTSFNVKTEKASNRRDFLRLYCYPL
QDYVHDWPLNPPSFREDVGDYCTSVRGLVLRLIEAISESLRLPSDYIDKEALGKHGQHMALNYYPPCPPPELTYGLPGHT
DPNLITIHRAVVSRDKERTLVPIIAENLHLIADVDNEGAGNMIYRNTFAVSEDLQSRDIILKKNSY (SEQ ID NO:
73)

>GAY54540.1 hypothetical protein CUMW_157450 [*Citrus unshiu*]
MSAVATTATKLLLSDLAPTLKNVPSDYIRPISDRPNLTDQAHISDGSIPLIDLQGLYGPRRSDIIKQIGQACQHCGFFQV
KNHGISEAMINNMLSIARTFFKLPESERLKIYSDDPSKPTRLSTSFNVKTEKVSNWRDFLRLHCYPLQDYVHDWPLNPPS
FRYI (SEQ ID NO: 74)

>GAY54539.1 hypothetical protein CUMW_157440 [*Citrus unshiu*]
MAAAATTTTKLLLSDRASTLKNVPSDYIRPISDRPNLTDQAHISEGSIPLIDLQGFYGLRRSDITKQIGQACQHGGFFQD
DVPGLQVLRDGNWVPVNPIPSTFIVNIGDQMQVLSNDRYKSVLHRAVVSRDKERISIPTFYCPSPDAVICPAKGLVDHDH
PAVYRDFTYAEYYEKFWNRGLATECCLDMFKASSTV (SEQ ID NO: 75)

>ESR34925.1 hypothetical protein CICLE_v10006618mg [*Citrus clementina*]
MAAATTKLLLSDLASTVKSVPSNYIRPISDRPNLTEVQISDGSIPLIDLQVLDGPRRLDIIKQIGQACQHDGFFQVKNHG
IPETIINNMLSIARAFFKLPESERLKSYSDDPSKSTRLSTSFNVNTEKVSNRRDYLRLHCYPLQDYIHEWPSNPPSFREV
VAEYCTSARGAWGLQRDYIDKALGKHGQHMALNYYPPCPQPDLTYGLPGHTDPNLITVLLQDDVPGLQVLRKGKWLPFSL
DYDFRIGYRPHTHIHNFESLAICLIPNTFIVNIGDQMQVLSNDRYKSVLHRALVNCDKEHISILTFYCSSPDAVIAHAKD
LIDERHPTVYKNFTYSEYY (SEQ ID NO: 76)

>KDO65454.1 hypothetical protein CISIN_1g042145mg, partial [*Citrus sinensis*]
MAAATTKLLLSDLASTVESVTSNYIRPISDRPNLTEVQISDGSIPLIDLQVLDGPRRLDLIKQIGQACHHDGFFQVKNHG
IPETIINNTLSIAGAFFKLPESERLKSYSDDPSKSKRLSTSFNVNTKKVSNWRDYLRLHCYPLQDCMHEWPSNPPSFEVV
AEYCTSVRGLVLKLLEAISESMGLQRDYIDKALGKHGQQMALNYCPPCPQPDLTYGLPGHTDPNLITVLLQDD (SEQ
ID NO: 77)

>XP_006465312.1 protein DMR6-LIKE OXYGENASE 2-like [*Citrus sinensis*]
MSAVATTATKLLLSDLAPTLKNVPSDYIRPISDRPNLTDQAHISDGSIPLIDLQGLYGPRRSDIIKQIGQACQHCGFFQV
KNHGISEAMINNMLSIARTFFKLPESERLKIYSDDPSKPTRLSTSFNVKTEKVSNWRDFLRLHCYPLQDYVHDWPLNPPS
FREDVGDYCTSVRGLVLRLIEAISESLGLPSDYIDKEALGKHGQHMALNYYPPCPQPELTYGLPGHTDPNLITILLQDDV
PGLQVLRDGNWVPVNPIPSTFIVNIGDQMQVLSNDRYKSVLHRAVVSRDKERISIPTFYCPSSDAVIGPAKGLVDQDLPA
VYRDFTYAEYYKKFWNRGLATECCLDMFKASSTV (SEQ ID NO: 78)

>XP_006427307.1 protein DMR6-LIKE OXYGENASE 2 [*Citrus clementina*]
MSAAATTATKLLLSDLAPTLTNVPSDYIRPISDRPSLTDQTHISDGSIPLIDLQGLNGPRRSDIIKQIGQACQHCGFFQV
KNHGISEAMINNMLSIARTFFKLPESERLKIYSDDPSKPTRLSTSFNVKTEKVSNWRDFLRLHCYPLQDYVHDWPLNPPS
FREDVGDYCTSVRGLVLRLIQAISESLGLPSDYIDKEALGKHGQHMALNYYPPCPQPELTYGLPGHTDPNLITLLLQDDV
PGLQVLRDGNWVPVNPIPSTFIVNIGDQMQVLSNDRYKSVLHRAVVSRDKERISIPTFYCSSPDAVIGPAKGLVDQDHPA
VYRDFTYAEYYKKFWNRGLATECCLEMFKASSTV (SEQ ID NO: 79)

>XP_015389438.1 protein DMR6-LIKE OXYGENASE 1-like [*Citrus sinensis*]
MAAATTKLLLSDLASTVKSVPSNYIRPISDRPNLTEVQISDGSIPLVDLQVLNGPSRLDIIKQIGQACQHDGFFQVKNHG
IPETIINNMLTIARAFFKLPEKSERLKSYSDDPSKSKRLSTSFNVNTKKVSNWRDYLRLHCYPLQDCMHEWPSNPPSFEV
VAEYCTSVRGLVLKLLEAISESMGLQRDYIDKALGKHGQQMALNYCPPCPQPDLTYGLPGHTDPNLITVLLQDDVMKQKQ
TLCP (SEQ ID NO: 80)

>CiDMR6_Ci117750.1 _*Citrus_ichangensis*
MSAVATTATKLLLSDLAPTLKNVPSDYIRPISDRPNLTDQAHISDGSIPL
IDLQGLYGPRRSDIIKQIGQACQHCGFFQVKNHGILEAMINNMLSIARTF TABLE 3-continued

| Polypeptide sequence of citrus plant negative immune response regulators |
|---|
| FNLPERERLKIYSDDPLKPTRLSTSFNVKTEKASNRRDFLRLHCYPLQDY<br>VHDWPLNPPSFREDVGDYCTSVRGLVLRLIEAISESLRLPSDYIDKEALG<br>KHGQHMTLNYYPPCPPPELTYGLPGHTDPNLITIHQAVVSRDKERTLVPI<br>IAENLHLIADVDNEGLIDQDHPAVYRDFTYAEYYEKSWNRGLAAQCCLDM<br>FKAS- (SEQ ID NO: 81) |
| PAO1 protein sequences |
| >PtPAO1_Ptrif.0004s2552.4.v1.3.1_*Poncirus_trifoliata*_v1.3.1<br>MDSTSRSSVIIIGAGISGISAGKILAENGIEDILILEASDRIGGRVRNEK<br>FGGVSVELGAGWIAGVGGKESNPVWELASKSGLRTCFSDYTNARYNIYDR<br>SGKIIPSGVAADSYKKAVESAIANLKNLEATNSNIGEVIKAAMELPSSPK<br>TPLELAIDFILHDFEMAEVEPISTYVDFGEREFLVADERGYAHLLYKMAE<br>EFLSTSDGKILDNRLKLNKVVRELQHSRNGVTVKTEDGCVYEANYVILSA<br>SIGVLQSDLISFKPPLPKWKTEAIEKCDVMVYTKIFLKFPCKFWPCSPEK<br>EFFIYAHERRGYYTFWQHMENAYPGSNILVVTLTNGESKRVEAQPDEETL<br>KEAMEVLRDMFGPDIPNATDILVPRWWNNRFQRGSYSDYPIISDNQLVNN<br>IRAPVGGIFFTGEHTSERFNGYVHGGYLAGIDTGKAVVEKIRKDNERNNS<br>ETQNFLLEPLLALTLTQTEAMPSLHKCDIPKQLYLSGKLGIPEAIL- (SEQ ID NO: 82) |
| >XP_006438967.1 polyamine oxidase 1 [*Citrus clementina*]<br>MDSTSRSSVIIIGAGVSGISAGKILAENGIEDILILEASDRIGGRVRNEKFGGVSVELGAGWIAGVGGKESNPVWELASK<br>SGLRTCFSDYTNARYNIYDRSGKIIPSGVAADSYKKAVESAIANLKNLEATNSNIGEVIKAATELPSSPKTPLELAIDFI<br>LHDFEMAEVEPISTYVDFGEREFLVADERGYAHLLYKMAEEFLSTSDGKILDNRLKLNKVVRELQHSRNGVTVKTEDGCV<br>YEANYVILSASIGVLQSDLISFKPPLPKWKTEAIEKCDVMVYTKIFLKFPCKFWPCSPEKEFFIYAHERRGYYTFWQHME<br>NAYPGSNILVVTLINGESKRVEAQPDEETLKEAMEVLQDMFGPDIPNATDILVPRWWNNRFQRGSYSNYPIISDNQLVNS<br>IRAPVGGIFFTGEHTSERFNGYVHGGYLAGIDTGKAVVEKIRKDNERNNSETQNFLLEPLLALTLTQTEAMSSLHKCDIP<br>KQLYLSGKLGIPEAIL (SEQ ID NO: 83) |
| >XP_024956636.1 polyamine oxidase 1 isoform X1 [*Citrus sinensis*]<br>MDSTSRSSVIIIGAGVSGISAGKILAENGIEDILILEASDRIGGRVRNEKFGGVSVELGAGWIAGVGGKESNPVWELASK<br>SGLRTCFSDYTNARYNIYDRSGKIIPSGVAADSYKKAVESAIANLKNLEATNSNIGEVIKAATELPSSPKTPLELAIDFI<br>LHDFEMAEVEPISTYVDFGEREFLVADERGYAHLLYKMAEEFLSTSDGKILDNRLKLNKVVRELQHSRNGVTVKTEDGCV<br>YEANYVILSASIGVLQSDLISFKPPLPQKWKTEAIEKCDVMVYTKIFLKFPCKFWPCSPEKEFFIYAHERRGYYTFWQHM<br>ENAYPGSNILVVTLTNGESKRVEAQPDEETLKEAMEVLQDMFGPDIPNATDILVPRWWNNRFQRGSYSNYPIISDNQLVN<br>SIRAPVGGIFFTGEHTSERFNGYVHGGYLAGIDTGKAVVEKIRKDNERNNSETQNFLLEPLLALTLTQTEAMSSLHKCDI<br>PKQLYLSGKLGIPEAIL (SEQ ID NO: 84) |
| >AJP16789.1 polyamine oxidase 1 [*Citrus trifoliata*]<br>MDSTSRSSVIIIGAGISGISAGKILAENGIEDILILEASDRIGGRVRNEKFGGVSVELGAGWIAGVGGKESNPVWELASK<br>SGLRTCFSDYTNARYNIYDRSGKIIPSGVAADSYKKAVESAIANLKNLEATNSNIGEVIKAAMELPSSPKTPLELAIDFI<br>LHDFEMAEVEPISTYVDFGEREFLVADERGYAHLLYKMAEEFLSTSDGKILDNRLKLNKVVRELQHSRNGVTVKTEDGCV<br>YEANYVILSASIGVLQSDLISFKPPLPKWKTEAIEKCDVMVYTKIFLKFPCKFWPCSPEKEFFIYAHERRGYYTFWQHME<br>NAYPGSNILVVTLTNGESKRVEAQPDEETLKEAMEALRDMFGPDIPNATDILVPRWWNNRFQRGSYSDYPIISDNQLVNN<br>IRAPVGGIFFTGEHTSERFNGYVHGGYLAGIDTGKAVVEKIRKDNERNNSETQNFLLEPLLALTLTQTEAMPSLHKCDIP<br>KQLYLSGKLGIPEAIL (SEQ ID NO: 85) |
| >SlPAO1_Solyc01g087590.2 sequence match in blast db Tomato Genome protein<br>sequences (ITAG release 2.40)<br>METPRRSSVIIVGAGISGLTAAKVLSENGVDDVVILEAADKIGGRIRKEEFGGVAAELGAGWIAGVGGKQSNPVWELALQ<br>SNLRTCFSDYSNARYNIYDHSGKIFPSGIAADSYKKAVDSAIQKLRSQEGNHNEDTDDAAETPSTPKTPIELAIDFILHD<br>FEMAEVEPISTYVDFGEREFLVADERGYEHLLYKMAENFLFTCEGKIMDSRLKLNTVVREVQHSRNGVLVTTEDGSLYEA<br>NYVILSVSIGVLQSDLISFSPSLPRWKMEAVRNLDVMVYTKIFLKFPNKFWPCEPEKEFFIYAHERRGYYTFWQHMENAY<br>PGSNMLVVTLTNGESKRVEAQSDQDTLREAMEVLRNMFGPDIPDATDILVPRWWNNRFQRGSYSNYPIYANHQLVHDIKE<br>PVGRIFFTGEHTSEKFSGYVHGGYLSGIDTSNALLEKMRRDDGRKNESQAFLLEPLLALTGSLTLTQAETVSSLHKCDIP<br>RQLFLSNSKLGLPEAIL (SEQ ID NO: 86) |
| >StPAO1_XP_006345421.1 PREDICTED: polyamine oxidase 1 [*Solanum tuberosum*]<br>MEIPRRSSVIIIGAGISGLTAAKVLSENGVDDVVILEAADKIGGRIRKEEFGGVAAELGAGWIAGVGGKQ<br>SNPVWELALQANLRTCFSDYSNARYNIYDHSGKIFPSGIAADSYKKAVDSAIQKLRSQEGNHNENTEDAA<br>ETPSTPKTPIELAIDFFLHDFEMAEVEPISTYVDFGEREFLVADERGYEHLLYKMAENFLFTSEGKIMDS<br>RLKLNTVVREVQHSRNGVLVTTEDGPLYEANYVILSVSIGVLQSDLISFSPPLPRWKMEAVRNLDVMIYT<br>KIFLKFPYKFWPCEPEKEFFIYAHERRGYYTFWQHMENAYPGSNMLVVTLTNGESKRVEAQSDQDTLREA<br>MEVLRNMFGPDIPNATDILVPRWWNNRFQRGSYSNYPIYANHQLVHDIKEPVGRIFFTGEHTSEKFSGYV<br>HGGYLSGIDSSNALLEKMRRDDGWKNESQAFLLEPLLALTGSLTLTQAETVSSLHKCDIPRQLFLSNSKL<br>AEAIL (SEQ ID NO: 87) |
| TPS5 protein sequences |
| >PtTPS5.1_Ptrif.0005s1029.1.v1.3.1_*Poncirus_trifoliata*<br>MVSRSYSNLLDLASGDFPNFSREKKRLPRVATVAGVLSEIDDENSNSVGS<br>DAPSSVSQERMIIVGNQLPLRAHRSSDGSGGWTFSWDEDSLLLQLKDGLG<br>EDVEVIYVGCIKEQIDLSEQDEVSQTLLETFKCVPAFIPPELFSKFYHGF<br>CKQHLWPLFHYMLPLSPDLGGRFDRSLWQAYVSVNKIFADKVMEVISPDD<br>DFVWVHDYHLMVLPTFLRKRFNRVKLGFFLHSPFPSSEIYRTLPIRDELL<br>RALLNADLIGFHTFDYARHFLSCCSRMLGVSYQSKRGYIGLEYFGRTVSI<br>KILPVGIHIGQLQSVLNLPETEAKVAELQDQFKGQIVMLGVDDMDIFKGI<br>SLKLLAMEQLLSQNPSKRGKIVLVQIANPARGRGRDVQEVQSETHATVRR |

TABLE 3-continued

| Polypeptide sequence of citrus plant negative immune response regulators |
|---|

INKIFGRPGYQPVVLIDTPLQFYERIAYYVIAECCLVTAVRDGMNLIPYE
YIICRQGNEKLDMTLGLDPSTAKSSMLVVSEFVGCSPSLSGAIRVNPWNI
DAVAEAMDSALGVSDAEKQMRHEKHYRYVSTHDVAYWARSFLQDLERACR
DHMRRRCWGIGFGLGFRVVALDPNFRKLSIDHIVSAYKRTKNRAILLDYD
GTMMVPGSISTSPNAEAVAILDNLCRDPKNVVFLVSGKDRDTLAEWFSSC
EGLGIAAEHGYFVRPNYGVDWETCVSVPDESWKQIAEPVMKLYTETTDGS
TIETKESALVWNFQYADPDFGSCQAKELLDHLESVLANEPVSVKSGPNIV
EVKPQGVNKGLVAQHQLETMHQKGMLPDFVLCIGDDRSDEDMFEVIKSAA
AGPSLSPVAEVFACTVGQKPSKAKYYLDDTAEILRMLLGLAEASAHNAYK
ASQGSQRVVINKE- (SEQ ID NO: 88)

> PtTPS5.2_Ptrif.0002s1896.1.v1.3.1_*Poncirus_trifoliata*
MVSKSYSNLLELASGEAPSFGRMSRRIPRIMTVAGIISDLDDDPADSVCS
DPSSSSVQRDRIIIVANQLPIRAQRKSDNSKGWIFSWDENSLLLQLKDGL
GDDDIEVIYVGCLKEEIHVNEQDEVSQILLETFKCVPTFLPPDLFSRYYH
GFCKQQLWPLFHYMLPLSPDLGGRFNRSLWQAYVSVNKIFADRIMEVINP
EDDFVWVHDYHLMVLPTFLRKRFNRVKLGFFLHSPFPSSEIYKTLPIREE
ILRALLNSDLIGFHTFDYARHFLSCCSRMLGLTYESKRGYIGLEYYGRTV
SIKILPVGIHMGQLQSVLSLPETEAKVSELVKQFHDQGKVMLLGVDDMDI
FKGISLKLLAMEQLLIQHPEWQGKVVLVQIANPARGRGKDVKEVQAETYS
TVERINQTFGKPGYDPVVLIDEPLKFYERIAYYVVAECCLVTAVRDGMNL
IPYEYIISRQGNEKLDKVVGSEPSSPKKSMLVVSEFIGCSPSLSGAIRVN
PWNIDAVADAMDGALEMADQEKQLRHEKHYRYVSTHDVGYWARSFLQDLE
RTCREHVRQRCWGIGFGLSFRVVALDPNFKKLSMEHIVSAYKRTTTRAIL
LDYDGTLMPQASIDKSPNSKTIDILNSLCRDKNNMVFLVSAKSRKTLAEW
FSPCENLGIAAEHGYFFRLRRDEEWETCIPVADCGWKQIAEPVMKLYTET
TDGSTIEDKETALVWSYEDADPDFGSCQAKELLDHLESVLANEPVTVKSG
QNLVEVKPQGVNKGLVAKRLLSTMQEWEMLPDFVLCVGDDRSDEDMFEVI
ISSTAGPSIAPRAEVFACTVVQKPSKAKYYLDDTVEIVRLMQGLACVADQ
MVSV- (SEQ ID NO: 89)

> PtTPS5.3_Ptrif.0002s2923.1.v1.3.1_*Poncirus_trifoliata*_
MSKSYTNLLDLASGNFPAMGPSREKKRLPRVMTVPGVISELDDDQANSVS
SDVPSSVAQDRVIIVANQLPVKAKRRPDNKGWSFSWDEDSLLLQLKDGLP
EDMEVIYVGSLKVDVDLSEQDDVSQLLLDRFKCVPAFLPPDILTKFYHGF
CKQHLWPLFHYMLPFSATHGGRFDRSLWEAYVSANKIFSQRVIEVINPED
DYVWIHDYHLMVLPTFLRRRFTRLRMGFFLHSPFPSSEIYRTLPVREEIL
KALLNADLIGFHTFDYARHFLSCCSRMLGLEYQSKRGYIGLEYYGRTVGI
KIMPVGIHMGQIESVLRLADKDWRVQELKQQFEGKTVLLGVDDMDIFKGV
DLKLLAMEHLLKQHPKWQGRAVLVQIANPARGRGKDLEEIQAEIHATCRR
INETFGRPGYEPVVFIDKPVSLSERAAYYTIAECVVVTAVRDGMNLTPYE
YIVCRQGVSGSESSSESSAPKKSMLVVSEFIGCSPSLSGAIRVNPWNIEA
TAEAMHEAIQMNEAEKQLRHEKHYRYVSTHDVAYWARSFFQDMERTCKDH
FKRRCWGIGLSFGFRVVALDPNFRKLSIDAIVSAYLRSKSRAILFDYDGT
VMPQTSINKAPSQAVISIINTLCNDARNAVFVVSGRGRDSLGKWFSPCKK
LGIAAEHGYFMRWSADEEWQNCGQSVDFGWIQIAEPVMKLYTESTDGSYI
EIKESALVWHHRDADPGFGSSQAKELLDHLESVLANEPAAVKSGQFIVEV
KPQGVSKGVVAEKIFTTMAESGRHADFVLCIGDDRSDEDMFEIIGNATSS
GVLSSNASVFACTVGQKPSKAKYYLDDAAEVVTMLEALAEASAPPSFEVG
ASDSP- (SEQ ID NO: 90)

>XP_006432798.1 alpha,alpha-trehalose-phosphate synthase [UDP-forming] 5 [*Citrus clementina*]
MVSRSYSNLLDLASGDFPNFSREKKRLPRVATVAGVLSEIDDENSNSVGSDAPSSVSQERMIIVGNQLPLRAHRSSDGSG
GWTFSWDEDSLLLQLKDGLGEDVEVIYVGCIKEQIDLSEQDEVSQTLLETFKCVPAFIPPELFSKFYHGFCKQHLWPLFH
YMLPLSPDLGGRFDRSLWQAYVSVNKIFADKVMEVISPDDDFVWVHDYHLMVLPTFLRKRFNRVKLGFFLHSPFPSSEIY
RTLPIRDELLRALLNADLIGFHTEDYARHFLSCCSRMLGVSYQSKRGYIGLEYFGRTVSIKILPVGIHIGQLQSVLNLPE
TEAKVAELQDQFKGQIVMLGVDDMDIFKGISLKLLAMEQLLSQNPSKRGKIVLVQIANPARGRGRDVQEVQSETHATVRR
INKIFGRPGYQPVVLIDTPLQFYERIAYYVIAECCLVTAVRDGMNLIPYEYIICRQGNEKLDMTLGLDPSTAKSSMLVVS
EFVGCSPSLSGAIRVNPWNIDAVAEAMDSALGVSDAEKQMRHEKHYRYVSTHDVAYWARSFLQDLERACRDHMRRRCWGI
GFGLGFRVVALDPNFRKLSIDHIVSAYKRTKNRAILLDYDGTIMVPGSISTSPNAEAVAILDNLCRDPKNVVFLVSGKDR
DTLAEWFSSCEGLGIAAEHGYFVRPNYGVDWETCVSVPDFSWKQIAEPVMKLYTETTDGSTIETKESALVWNFQYADPDF
GSCQAKELLDHLESVLANEPVSVKSGPNIVEVKPQGVNKGLVAQHQLETMHQKGMLPDFVLCIGDDRSDEDMFEVIKSAA
AGPSLSPVAEVFACTVGQKPSKAKYYLDDTAEILRMLLGLAEASAQDACKASLGSQRVVINKE (SEQ ID NO: 91)

>GAY56626.1 hypothetical protein CUMW_173340 [*Citrus unshiu*]
MVLIPTCHLQCCLAEVGVRRASKVLLDSKRSSEYDVSLFEDFCREKKRLPRVATVAGVLSEIDDENSNSVGSDAPSSVSQ
ERMIIVGNQLPLRAHRSSDGSGGWTFSWDEDSLLLQLKDGLGEDVEVIYVGCIKEQIDLSEQDEVSQTLLETFKCVPAFI
PPELFSKFYHGFCKQHLWPLFHYMLPLSPDLGGRFDRSLWQAYVSVNKIFADKVMEVISPDDDFVWVHDYHLMVLPTFLR
KRFNRVKLGFFLHSPFPSSEIYRTLPIRDELLRALLNADLIGFHTEDYARHFLSCCSRMLGVSYQSKRGYIGLEYFGRTV
SIKILPVGIHIGQLQSVLNLPETEAKVAELQDQFKGQIVMLGVDDMDIFKGISLKLLAMEQLLSQNPSKRGKIVLVQIAN
PARGRGRDVQEVQSETHATVRRINKIFGRPGYQPVVLIDTPLQFYERIAYYVIAECCLVTAVRDGMNLIPYEYIICRQGN
EKLDMTLGLDPSTAKSSMLVVSEFVGCSPSLSGAIRVNPWNIDAVAEAMDSALGVSDAEKQMRHEKHYRYVSTHDVAYWA
RSFLQDLERACRDHMRRRCWGIGFGLGFRVVALDPNERKLSIDHIVSAYKRTKNRAILLDYDGTIMVPGSISTSPNAEAV
AILDNLCRDPKNVVFLVSGKDRDTLAEWFSSCEGLGIAAEHGYFVRPNYGVDWETCVSVPDFSWKQIAEPVMKLYTETTD
GSTIETKESALVWNFQYADPDFGSCQAKELLDHLESVLANEPVSVKSGPNIVEVKPQGVNKGLVAQHQLETMHQKGMLPD
FVLCIGDDRSDEDMFEVIKSAAAGPSLSPVAEVFACTVGQKPSKAKYYLDDTAEILRMLLGLAEASAHDACKASQGSQRV
VINKE (SEQ ID NO: 92)

TABLE 3-continued

| Polypeptide sequence of citrus plant negative immune response regulators |
| --- |

>KDO53157.1 hypothetical protein CISIN_1g002958mg [*Citrus sinensis*]
MIIVGNQLPLRAHRSSDGSGGWTFSWDEDSLLLQLKDGLGEDVEVIYVGCIKEQIDLSEQDEVSQTLLETFKCVPAFIPP
ELFSKFYHGFCKQHLWPLFHYMLPLSPDLGGRFDRSLWQAYVSVNKIFADKVMEVISPDDDFVWVHDYHLMVLPTFLRKR
FNRVKLGFFLHSPFPSSEIYRTLPIRDELLRALLNADLIGFHTFDYARHFLSCCSRMLGVSYQSKRGYIGLEYFGRTVSI
KILPVGIHIGQLQSVLNLPETEAKVAELQDQFKGQIVMLGVDDMDIFKGISLKLLAMEQLLSQNPSKRGKIVLVQIANPA
RGRGRDVQEVQSETHATVRRINKIFGRPGYQPVVLIDTPLQFYERIAYYVIAECCLVTAVRDGMNLIPYEYIICRQGNEK
LDMTLGLDPSTAKSSMLVVSEFVGCSPSLSGAIRVNPWNIDAVAEAMDSALGVSDAEKQMRHEKHYRYVSTHDVAYWARS
FLQDLERACRDHMRRRCWGIGFGLGFRVVALDPNFRKLSIDHIVSAYKRTKNRAILLDYDGTIMVPGSISTSPNAEAVAI
LDNLCRDPKNVVFLVSGKDRDTLAEWFSSCEGLGIAAEHGYFVRPNYGVDWETCVSVPDESWKQIAEPVMKLYTETTDGS
TIETKESALVWNFQYADPDFGSCQAKELLDHLESVLANEPVSVKSGPNIVEVKPQGVNKGLVAQHQLETMHQKGMLPDFV
LCIGDDRSDEDMFEVIKSAAAGPSLSPVAEVFACTVGQKPSKAKYYLDDTAEILRMLLGLAEASAQDACKASLGSQRVVI
NKE (SEQ ID NO: 93)

>XP_006448141.1 alpha,alpha-trehalose-phosphate synthase [UDP-forming] 6 [*Citrus clementina*]
MVSKSYSNLLELASGEAPSFGRMRRRIPRIMTVAGIISDLDDDPADSVCSDPSSSSVQRDRIIIVANQLPIRAQRKSDNS
KGWIFSWDENSLLLQLKDGLGDDDIEVIYVGCLKEEIHVNEQDEVSQILLDTFKCVPTFLPPDLFSRYYHGFCKQQLWPL
FHYMLPLSPDLGGRFNRSLWQAYVSVNKIFADRIMEVINPEDDFVWVHDYHLMVLPTFLRKRFNRVKLGFFLHSPFPSSE
IYKTLPIREEILRALLNSDLIGFHTEDYARHFLSCCSRMLGLTYESKRGYIGLEYYGRTVSIKILPVGIHMGQLQSVLSL
PGTEAKVSELIKQFHDQGKVMLLGVDDMDIFKGISLKLLAMEQLLIQHPEWQGKVVLVQIANPARGRGKDVKEVQAETYS
TVERINQTFGKPGYDPVVLIDEPLKFYERIAYYVVAECCLVTAVRDGMNLIPYEYIISRQGNEKLDKVLGSEPSSPKKSM
LVVSEFIGCSPSLSGAIRVNPWNIDAVSDAMDSALEMADQEKQLRHEKHYRYVSTHDVGYWARSFLQDLERTCREHVRQR
CWGIGFGLSFRVVALDPNFKKLSMEHIVSAYKRTTTRAILLDYDGTLMPQASIDKSPNSKTIDILNSLCRDKNNMVFLVS
AKSRKTLAEWFSPCENLGIAAEHGYFFRLRRDEEWETCIPVADCGWKQIAEPVMKLYTETTDGSTIEDKETALVWSYEDA
DPDFGSCQAKELLDHLESVLANEPVTVKSGQNLVEVKPQGVNKGLVAKRLLSTMQEREMLPDFVLCVGDDRSDEDMFEVI
ISSMAGPSIAPRAEVFACTVGRKPSKAKYYLDDTVEIVRLMQGLACVADQMVPV (SEQ ID NO: 94)

>KDO60795.1 hypothetical protein CISIN_1g044635mg [*Citrus sinensis*]
MVSKSYSNLLELASGEAPSFGRMRRRIPRIMTVAGIISDLDDDPADSVCSDPSSSSVQRDRIIIVANQLPIRAQRKSDNS
KGWIFSWDENSLLLQLKDGLGDDDIEVIYVGCLKEEIHVNEQDEVSQILLDTFKCVPTFLPPDLFSRYYHGFCKQQLWPL
FHYMLPLSPDLGGRFNRSLWQAYVSVNKIFADRIMEVINPEDDFVWVHDYHLMVLPTFLRKRFNRVKLGFFLHSPFPSSE
IYKTLPIREEILRALLNSDLIGFHTFDYARHFLSCCSRMLGLTYESKRGYIGLEYYGRTVSIKILPVGIHMGQLQSVLSL
PGTEAKVSELIKQFHDQGKVMLLGVDDMDIFKGISLKLLAMEQLLIQHPEWQGKVVLVQIANPARGRGKDVKEVQAETYS
TVERINQTFGKPGYDPVVLIDEPLKFYERIAYYVVAECCLVTAVRDGSEPSSPKKSMLVVSEFIGCSPSLSGAIRVNPWN
IDAVSDAMDSALEMADQEKQLRHEKHYRYVSTHDVGYWARSFLQDLERTCREHVRQRCWGIGFGLSFRVVALDPNFKKLS
MEHIVSAYKRTTTRAILLDYDGTLMPQASIDKSPNSKTIDILNSLCRDKNNMVFLVSAKSRKTLAEWFSPCENLGIAAEH
GYFFRLRRDEEWETCIPVADCGWKQIAEPVMKLYTETTDGSTIEDKETALVWSYEDADPDFGSCQAKELLDHLESVLANE
PVTVKSGQNLVEVKPQGVNKGLVAKRLLSTMQEREMLPDFVLCVGDDRSDEDMFEVIISSMAGPSIAPRAEVFACTVGRK
PSKAKYYLDDTVEIVRLMQGLACVADQMVPV (SEQ ID NO: 95)

>XP_006449549.1 probable alpha,alpha-trehalose-phosphate synthase [UDP-forming] 7 [*Citrus clementina*]
MMSKSYTNLLDLASGNFPAMGPSREKKRLPRVMTVPGVISELDDDQANSVSSDVPSSVAQDRVIIVANQLPVKAKRRPDN
KGWSFSWDEDSLLLQLKDGLPEDMEVIYVGSLKVDVDLSEQDDVSQLLLDRFKCVPAFLPPDILTKFYHGFCKQHLWPLF
HYMLPFSATHGGRFDRSLWEAYVSANKIFSQRVIEVINPEDDYVWIHDYHLMVLPTFLRRRFTRLRMGFFLHSPFPSSEI
YRTLPVREEILKALLNADLIGFHTFDYARHFLSCCSRMLGLEYQSKRGYIGLEYYGRTVGIKIMPVGIHMGQIESVLRLA
DKDWRVQELKQQFEGKTVLLGVDDMDIFKGVDLKLLAMEHLLKQHPKWQGRAVLVQIANPARGRGKDLEEIQAEIHATCK
RINETFGRPGYEPVVFIDKPVTLSERAAYYTIAECVVVTAVRDGMNLTPYEYIVCRQGVSGSESSSESSAPKKSMLVVSE
FIGCSPSLSGAIRVNPWNIEATAEAMHEAIQMNEAEKQLRHEKHYRYVSTHDVAYWARSFFQDMERTCKDHFKRRCWGIG
LSFGFRVVALDPNFRKLSIDAIVSAYLRSKSRAILFDYDGTVMPQTSINKAPSQAVISIINTLCNDARNTVFVVSGRGRD
SLGKWFSPCKKLGIAAEHGYFMRWSADEEWQNCGQSVDFGWIQIAEPVMKLYTESTDGSYIEIKESALVWHHRDADPGFG
SSQAKELLDHLESVLANEPAAVKSGQFIVEVKPQGVSKGVVAEKIFTTMAESGRHADFVLCIGDDRSDEDMFEIIGNATS
SGVLSSNASVFACTVGQKPSKAKYYLDDAAEVVTMLEALAEASAPPSFEVGASDSP (SEQ ID NO: 96)

>XP_006467609.1 probable alpha,alpha-trehalose-phosphate synthase [UDP-forming] 7 [*Citrus sinensis*]
MMSKSYTNLLDLASGNFPAMGPSREKKRLPRVMTVPGVISELDDDQANSVSSDVPSSVAQDRVIIVANQLPVKAKRRPDN
KGWSFSWDEDSLLLQLKDGLPEDMEVIYVGSLKVDVDLSEQDDVSQLLLDRFKCVPAFLPPDILTKFYHGFCKQHLWPLF
HYMLPFSATHGGRFDRSLWEAYVSANKIFSQRVIEVINPEDDYVWIHDYHLMVLPTFLRRRFTRLRMGFFLHSPFPSSEI
YRTLPVREEILKALLNADLIGFHTFDYARHFLSCCSRMLGLEYQSKRGYIGLEYYGRTVGIKIMPVGIHMGQIESVLRLA
DKDWRVQELKQQFEGKTVLLGVDDMDIFKGVDLKLLAMEHLLKQHPKWQGRAVLVQIANPARGRGKDLEEIQAEIHATCK
RINETFGRPGYEPVVFIDKPVTLSERAAYYTIAECVVVTAVRDGMNLTPYEYIVCRQGVSGSESSSESSAPKKSMLVVSE
FIGCSPSLSGAIRVNPWNIEATAEAMHEAIQMNEAEKQLRHEKHYRYVSTHDVAYWARSFFQDMERTCKDHFKRRCWGIG
LSFGFRVVALDPNFRKLSIDAIVSAYLRSKSRAILFDYDGTVMPQTSINKAPSQAVISIINTLCNDARNTVFVVSGRGRD
CLGKWFSPCKKLGIAAEHGYFMRWSADEEWQNCGQSVDFGWIQIAEPVMKLYTESTDGSYIEIKESALVWHHRDADPGFG
SSQAKELLDHLESVLANEPAAVKSGQFIVEVKPQGVSKGVVAEKIFTTMAESGRHADFVLCIGDDRSDEDMFEIIGNATS
SGVLSSNASVFACTVGQKPSKAKYYLDDAAEVVTMLEALAEASAPPSFEVGASDSP (SEQ ID NO: 97)

>KDO77921.1 hypothetical protein CISIN_1g003025mg [*Citrus sinensis*]
MMSKSYTNLLDLASGNFPAMGPSREKKRLPRVMTVPGVISELDDDQANSVSSDVPSSVAQDRVIIVANQLPVKAKRRPDN
KGWSFSWDEDSLLLQLKDGLPEDMEVIYVGSLKVDVDLSEQDDVSQLLLDRFKCVPAFLPPDILTKFYHGFCKQHLWPLF
HYMLPFSATHGGRFDRSLWEAYVSANKIFSQRVIEVINPEDDYVWIHDYHLMVLPTFLRRRFTRLRMGFFLHSPFPSSEI
YRTLPVREEILKALLNADLIGFHTFDYARHFLSCCSRMLGLEYQSKRGYIGLEYYGRTVGIKIMPVGIHMGQIESVLRLA
DKDWRVQELKQQFEGKTVLLGVDDMDIFKGVDLKLLAMEHLLKQHPKWQGRAVLVQIANPARGRGKDLEEIQAEIHATCK
RINETFGRPGYEPVVFIDKPVTLSERAAYYTIAECVVVTAVRDGMNLTPYEYIVCRQGVSGSESSSESSAPKKSMLVVSE
FIGCSPSLSGAIRVNPWNIEATAEAMHEAIQMNEAEKQLRHEKHYRYVSTHDVAYWARSFFQDMERTCKDHFKRRCWGIG
LSFGFRVVALDPNFRKLSIDAIVSAYLRSKSRAILFDYDGTVMPQTSINKAPSQAVISIINTLCNDARNTVFVVSGRGRD TABLE 3-continued

| Polypeptide sequence of citrus plant negative immune response regulators |
|---|
| CLGKWFSPCKKLGIAAEHGYFMRWSADEEWQNCGQSVDEGWIQIAEPVMKLYTESTDGSYIEIKESALVWHHRDADPGFG SSQAKELLDHLESVLANEPAAVKSGQFIVEVKPQVYIQLRI (SEQ ID NO: 98) |
| ACA11 protein sequences |
| >PtACA11.1_Ptrif.0004s2523.1.v1.3.1_*Poncirus_trifoliata* MENYLKKNFDVDPKRPSEEALMRWRSAVRVVKNPRRRFRMVADLAKRAEA ERKRKKLQEKLRVALYVQKAALHFIDAGSRPIEYKLSQETLLAGYGIEPD ELESIVRSHNSKAVESHGGVEGLAREVSVSLPDGVASEEVSNRQNVYGFN RYAEKPARSFWMFVWEALHDLTLIILMICAAVSIGVGIPTEGWPDGMYDG LGIVLSILLVVIVTAVSDYKQSLQFKALDKEKKNLIVQVTRDGYRKKLSI YDLVVGDIVHLSIGDQVPADGILISGYNLTIDESSLSGETEPVHINRDRP FLLSGTKVQDGSGKMLVTSVGMRTEWGRLMVTLSEGGEDETPLQVKLNGV ATVIGKIGLVFAVLTFLVLTLRFLVEKAQHHQIKNWSSIDAMKLLNYFAI AVTIVVVAVPEGLPLAVTLSLAFAMKKLMNDKALVRHLSACETMGSASCI CTDKTGTLTTNHMVVTKLWICNEAKTIKRGDNEKLLKPSVSDAVFNIFLQ SIFQNTGSEVVKDKDGRTNILGTPTERAILEFGLILGGDSKFHREESAIV KVEPFNSVKKRMSVLVSLPNNGGFRAFCKGASEIILNMCNKIINADRKAV PISEEQRKNLTNVINGFSSEALRTLCLAFQDIKGNHKAESIPENNYTLIA VVGIKDPVRPGVREAVETCLAAGITVRMVTGDNIHTAKAIAKECGILTDG GLAIEGTDFRSKNPQEMQELIPKLQVMARSSPTDKYILVTQLRNVFKEVV AVTGDGTNDAPALHEADIGLAMGIAGTEVAKENADVIIMDDNFTTIVTVA RWGRSVYINIQKFVQFQLTVNIVALVINFVAACITGSAPLTAVQLLWVNM IMDTLGALALATEPPHEGLMQRPPIGRNVHFITVTMWRNIIGQSIYQIIV LGVLTFCGKKILKLSGPNATLILNTFIFNSFVFCQVENEINSRDMEKINV FRGIFSSWVFIAVLVATVGFQVIIVELLGTFATTVPLNWKLWLASVVIGA ISMPFGVLLKCIPAGTCTSAANSKHHDGYEPLPTGPDLA- (SEQ ID NO: 99) |
| > PtACA11.2_Ptrif.0009s1528.2.v1.3.1_*Poncirus_trifoliata* MDKFLNWKDFDVEHKNPSEEALRRWRSAVSIVKNRRRRFRMVADLVKRSE GEKKKLKIQEKIRVALYVQKAALTFIDAAGRPEYKLSEETRDAGFLIDPD DLAAIVRGRDIKGLKSNDGVEGVAQKLSVSLNEGVCKRDLPIRQKIYGVN RYTEKPPRSFLMFVWDALQDLTLIILIVCAVLSIGVGLATEGWPEGMYDG LGIILSILLVVMVTAISDYKQSLQFRDLDREKKKIFIQVTRDGQRQKVSI YDLVVGDIVHLSIGDQVAADGIFISGYSLLIDESSLSGESEPMYICEENP FLLAGTKVQDGSGKMLVTTVGMRTEWGKLMETLNEGGEDETPLQVKLNGV ATIIGKIGLFFSVLTFLVLAGRFLGEKAIHNEFTVWSSADALTLIDYFAV AVTIIVVAVPEGLPLAVTLSLAFAMKKLMNDRALVRHLSACETMGSASCI CTDKTGTLTTNHMVVDKIWICNTISKVEGNNKEDILQLEISERVLDITLQ AIFQNTGSEVVKDKDGKNSILGTPTESAILEFGLRLGGDFEAQRREFKIV KVEPFNSVRKKMSVLIALPAGGMRAFCKGASEIVLSMCDKVVSDNGEPVP LSEEQFRNITDVINGFASEALRTLCLAFKDLNDSSNENNIPDSGYTLIAV VGIKDPVRPGVKEAVQTCLEAGITVRMVTGDNINTARAIAKECGILTSDG EAVEGPEFRNMSPADMKRIIPKLQVMARSLPLDKHTLVTQLRKTFGEVVA VTGDGTNDAPALHEADIGLSMGIAGTEVAKGNADVIILDDNFSTIVNVAK WGRAVYINIQKFVQFQLTVNVVALVINFVSACASGSAPLTAVQLLWVNMI MDTLGALALATEPPHEGLMKRPPVAKGESFITKVMWRNIIGQSIYQLIIL VALNFDGKQILGLSGSDATAVLNTVIFNSFVFCQVFNEINSREMEKINVF KGMFDSWMFVGILVLTVAFQIIIIEFLGAFASTVPLSWHLWLLCILIGAV SMPIAVVIKCIPVKKSEPKLQHHDGYEEIPSGPESA- (SEQ ID NO: 100) |
| > PtACA11.3_Ptrif.0007s0578.1.v1.3.1_*Poncirus_trifoliata* MESYLQENFGVKPKHSSTEALEKWRNLCGVVKNPKRRFRFTANLPKRYEA AAMRKTNQEKLRIAVLVSKAAIQFLLGVTPSDYNVPEEVKAAGFQVCAEE LGSITEGHDVKKLKFHGGVTGIAEKLSTSISDGLTSNTDLFNRRQEIYGL NQFAESTPRSFWVFVWEALQDMTLMILGACAFVSLIVGIVMEGWPHGAHD GLGIVASILLVVFVTATSDYRQSLQFKDLDKEKKKIFVQVTRNGFRQKLS IYDLLPGDIVHLGIGDQVPADGLFVSGFSVLIDESSLTGESEPVMVNEEN PFMLSGTKLQDGSCKMMVTTVGMRTQWGKLMATLSEGGDDETPLQVKLNG VATIIGKGGLFFAVVTFAVLVQGLLSHKLGEGSIWSWSGDDALKLLEYFA VAVTIVVVAVPEGLPLAVTLSLAFAMKKMMNDKALVRHLAACETMGSASS ICSDKTGTLTTNHMTVVKSCICMNVKEVSKTDSASSLCSEIPDSAVQLLL QSIFTNTGGEVVVNKDGKREILGTPTETALLEFGLSLGGDFQAERQTSKI VKVEPFNSSKKRMGVVLELPGGGLRVHSKGASEIVLSGCDKVVNSTGEVV PLDEESLNHLKLTIDQFANEALRTLCLAFMELETGFSPENPIPVSGYTLI AIVGIKDPVRPGVKESVAVCRSAGITVRMVTGDNINTAKAIARECGILTD DGIAIEGPVFREKTTEELMELIPKIQVMARSSPLDKHTLVKHLRTTFDEV VAVTGDGTNDAPALHEADIGLAMGIAGTEVAKESADVIILDDNFSTIATV AKWGRSVYINIQKFVQFQLTVNIVALIVNFSSACLTGSAPLTAVQLLWVN MIMDTLGALALATEPPTDELMKRPPVGKRGNFISNVMWRNILGQSLYQFM VISLLQAKGKAIFWLDGPDSTLVLNTLIFNSFVFCQIFNEISSREMEEIN VFKGILDNYVFASVLGVTVFFQIIIVEFLGTFANTTPLTLTQWFASIVIG FIGMPIAAGLKTIQV- (SEQ ID NO: 101) |
| > PtACA11.4_Ptrif.0005s1708.2.v1.3.1_*Poncirus_trifoliata* MENYLNENFSDVKAKNTSEEALQRWRKLCGFVKNKKRRFRFTANLSKRFE AEAIRRSNQEKFRVAVLVSQAALQFIHGLNLSSEYTVPEEVAASGFQICP DELGSIVEGHDIKKLKVHGGVEGIAEKLSTSITDGISTSEQLLNRRKEIY |

TABLE 3-continued

| Polypeptide sequence of citrus plant negative immune response regulators |
| --- |

GINKFTESPARGFWVYVWEALHDMTLMILAVCALVSLVVGIATEGWPKGA
HDGLGIVMSILLVVFVTATSDYKQSLQFKDLDKEKKKITVQVARNGFRRK
ISIYDLLPGDIVHLCMGDQVPADGLFVSGFSVLINESSLTGESEPVNVNA
LNPFLLSGTKVQNGSCKMLVTTVGMRTQWGKLMATLSEGGDDETPLQVKL
NGVATIIGKIGLFFAVVTFAVMVQGLFTRKLQEGTHWTWSGDDALEILEF
FAIAVTIVVVAVPEGLPLAVTLSLAFAMKKMMNDKALVRHLAACETMGSA
TSICSDKTGTLTTNHMTVLKACICEEIKEVDNYKGTPAFGSSIPASASKL
LLQSIFNNTGGEVVIGEGNKTEILGTPTETAILEFGLLLGGDFQAERQAS
KIVKVEPENSVKKQMGVVIELPEGGFRVHCKGASEIILAACDKELNANGE
VVPLNEAAVNHLNKTIEKFASEALRTLCLAYMEIGNEFSADAPIPTQGYT
CIGIVGIKDPMRPGVKESVAICRSAGITVRMVTGDNINTAKAIARECGIL
TDNGIAIEGPEFREKSDEELSKLIPKIQVMARSSPMDKHTLVKHLRTTLG
EVVAVTGDGTNDAPALHEADIGLAMGIAGTEVAKESADVIILDDNFSTIV
TVAKWGRSVYINIQKFVQFQLTVNVVALIVNFSSACLTGNAPLTAVQLLW
VNMIMDTLGALALATEPPNGDLMKRSPVGRKGNFISNVMWRNILGQSLYQ
FLIIWYLQTRGKAVFHLDGPDPDLILNTLIFNTFVFCQVFNEISSREMEK
INVLKGILKNYVFVAVLTCTVLFQIIIIELLGTFANTTPLNLQQWFVSIL
LGFLGMPIAAVLKLIHVG- (SEQ ID NO: 102)

> PtACA11.5_Ptrif.0009s1531.2.v1.3.1_*Poncirus_trifoliata*
MDKFFNWKDFDVEHKNPSEEALRRWRSAACIVKNRRRRFRMVADLDKRSD
AEKKKLEIKQKIQVAIDVQREALRLTDAAGRAEYKLSEETRQAGFGTDPD
DLAAIVCGHDTEGLKSNEGVEGVAQKLSVSLNEGVRKRDVPIRQNIYGVN
RYTEKPPRSFFMFVWEALQDLTLIILMVCAGLSIGVGLAREGWPEGIYDG
LGIILSKFLVVMVTAISDYKQSLQFRDLDREKKKIFIQVTRDGQRQKVCI
YDLVVGDIVHLSIGDQVPADGIFISGHSLLIDESSLSGQSEPRYMYEENP
FLLAGTEVQGGSGKMLVTTVGMRTEWGKLMETLNEGGEDETPLQVKLNGV
ATIIGKIELFFSVLEFLVLIGRFLGEKVIHNEFTDWSSADALTLIDYFAV
VVTIIDVAVPEGLPLAVTLSLAFAVKKLMNDGALVRHLSACETMGSASCI
CTDKTGTLTTNHMVVDKIWICNTISKVEGNNREDILQLEISERVLDITLQ
AIFQNTGSEVVEDKDGKNSILGTPTESAILEFGLRLGGDFEAQRREFKLV
KVEPFNSVRKKMSVLIALPAGGMRAFCKGASEIVLSMCDKVVSDNGEPVP
LSEEQFRNITDVINGFASEALRTLCLAFKDLNDSSNENNIPDSGYTLIAV
VGIKDPVRPGVKEAVQTCLEAGITVRMVTGDNINTARAIAKECGILTSDG
EAVEGPEFRNMSPADIIPKLQVMARSLPSDKHTLVTQLRNTFGEVVAVTG
DGTNDAAALHEADIGLAMGIAGTECKISAEQNKFIKK- (SEQ ID NO: 103)

>XP_006438912.1 putative calcium-transporting ATPase 11, plasma membrane-type
[*Citrus clementina*]
MENYLKKNFDVDPKRPSEEALMRWRSAVRVVKNPRRRFRMVADLAKRAEAERKRKKLQEKLRVALYVQKAALHFIDAGSR
PIEYKLSQETLLAGYGIEPDELESIVRSHNSKAVESHGGVEGLAREVSVSLPDGVASEEVSNRQNVYGFNRYAEKPARSF
WMFVWEALHDLTLIILMICAAVSIGVGIPTEGWPDGVYDGLGIVLSILLVVIVTAVSDYKQSLQFKALDKEKKNLIVQVT
RDGYRKKLSIYDLVVGDIVHLSIGDQVPADGILISGYSLTIDESSLSGETEPVHINRDRPFLLSGTKVQDGSGKMLVTSV
GMRTEWGRLMVTLSEGGEDETPLQVKLNGVATVIGKIGLVFAVLTFLVLALRFLVEKAQHHQIKNWSSIDAMKLLNYFAI
AVTIVVVAVPEGLPLAVTLSLAFAMKKLMNDKALVRHLSACETMGSASCICTDKTGTLTTNHMVVTKLWICNEAKTIKSG
DNEKLLKPSVSDAVENIFLQSIFQNTGSEVVKDKDGRTNILGTPTERAILEFGLILGGDSTFHREESAIVKVEPFNSVKK
RMSVLVSLPNNGGFRVFCKGASEIILNMCDKIINADGKAVPISEEQRKNLTNVINGFSSEALRTLCLAFQDIKGNHKAES
IPENNYTLIAVVGIKDPVRPGVREAVETCLAAGITVRMVTGDNIHTAKAIAKECGILTDGGLAIEGTDFRSKNPQEMQEL
IPKLQVMARSSPTDKYILVTQLRNVFKEVVAVTGDGTNDAPALHEADIGLAMGIAGTEVAKENADVIIMDDNFTTIVTVA
RWGRSVYINIQKFVQFQLTVNIVALVINFVAACITGSAPLTAVQLLWVNMIMDTLGALALATEPPHEGLMQRPPIGRNVH
FITVTMWRNIIGQSIYQIIVLGVLTFCGKKILKLSGPNATLILNTFIENSFVFCQVFNEINSRDMEKINVFRGIFSSWVF
VAVLVATVGFQVIIVELLGTFATTVPLNWKLWLASVVIGAISMPFGVLLKCIPVGTCTSAANSKHHDGYEPLPTGPDLA
(SEQ ID NO: 104)

>KDO83263.1 hypothetical protein CISIN_1g0016382mg, partial [*Citrus sinensis*]
EKLRVALYVQKAALHFIDAGSRPIEYKLSQETLLAGYGIEPDELESIVRSHNSKAVESRGGVEGLAREVSVSLPDGVASE
EVSNRQNVYGFNRYAEKPARSFWMFVWEALHDLTLIILMICAAVSIGVGIPTEGWPDGVYDGLGIVLSILLVVIVTAVSD
YKQSLQFKALDKEKKNLIVQVTRDGYRKKLSIYDLVVGDIVHLSIGDQVPADGILISGYSLTIDESSLSGETEPVHINRD
RPFLLSGTKVQDGSGKMLVTSVGMRTEWGRLMVTLSEGGEDETPLQVKLNGVATVIGKIGLVFAVLTFLVLALRFLVEKA
QHHQIKHWSSIDAMKLLNYFAIAVTIVVVAVPEGLPLAVTLSLAFAMKKLMNDKALVRHLSACETMGSASCICTDKTGTL
TTNHMVVTKLWICNEAKTIKSGDNEKLLKPSVSDAVFNIFLQSIFQNTGSEVVKDKDGRTNILGTPTERAILEFGLILGG
DSTFHREESAIVKVEPFNSVKKRMSVLVSLPNNGGFRVFCKGASEIILNMCDKIINADGKAVPISEEQRKNLTNVINGFS
SEALRTLCLAFQDIKGNHKAESIPENNYTLIAVVGIKDPVRPGVREAVETCLAAGITVRMVTGDNIHTAKAIAKECGILT
DGGLAIEGTDFRSKNPQEMQELIPKLQVMARSSPTDKYILVTQLRNVFKEVVAVTGNGTNDAPALHEADIGLAMGIAGTE
VAKENADVIIMDDNFTTIVTVARWGRSVYINIQKFVQFQLTVNIVALVINFVAACITGSAPLTAVQLLWVNMIMDTLGAL
ALATEPPHEGLMQRPPIGRNVHFITVTMWRNIIGQSIYQIIVLGVLTFCGKKILKLSGPNATLILNTFIFNSFVFCQVFN
EINSRDMEKINVFRGIFSSWVFIAVLVATVGFQVIIVELLGTFATTVPLNWKLWLASVVIGAISMPFGVLLKCIPVGTCT
SAANSKHHDGYEPLPTGPDLA (SEQ ID NO: 105)

>XP_006492951.1 putative calcium-transporting ATPase 11, plasma membrane-type
[*Citrus sinensis*]
MDKFLNWKDFDVEHKNPSEEALRRWRSAVSIVKNRRRRFRMVADLVKRSEGEKKKLKIQEKIRVALYVQKAALTFIDAAG
RPEYKLSEETREVGFRIEPDDLAVIVRGRDIKGLKSNDGVEGVAQKLSVSLNEGVCKRDLPIRQKIYGVNRYTEKPPRSF
LMFVWDALQDLTLIILIVCAVLSIGVGLATEGWPEGMYDGLGIILSILLVVMVTAISDYKQSLQFRDLDREKKKIFIQVT
RDGQRQKVSIYDLVVGDIVHLSIGDQVAADGIFISGYSLLIDESSLSGESEPMYICEENPFLLAGTKVQDGSGKMLVTTV
GMRTEWGKLMETLNEGGEDETPLQVKLNGVATIIGKIGLFFSVLTFLVLAGRFLGEKAIHNEFTVWSSADALTLIDYFAV
AVTIIVVAVPEGLPLAVTLSLAFAMKKLMNDRALVRHLSACETMGSASCICTDKTGTLTTNHMVVDKIWICNTISKVEGN
NREDILQLEISERVLDVTLQAIFQNTGSEVVKDKDGKNSILGTPTESAILEFGLHLGGDFEAQRREFKIVKVEPFNSVRK TABLE 3-continued

| Polypeptide sequence of citrus plant negative immune response regulators |
|---|
| KMSVLIALPAGGMRAFCKGASEIVLSMCDKVVSDNGEPVPLSEEQFRNITDVINGFASEALRTLCLAFKDLNDSSNENNI PDSGYTLIAVVGIKDPVRPGVKEAVQTCLEAGITVRMVTGDNINTARAIAKECGILTSDGEAVEGPEERNMSPADMKRII PKLQVMARSLPLDKHTLVTQLRKTFGEVVAVTGDGTNDAPALHEADIGLSMGIAGTEVAKGNADVIILDDNFSTIVNVAK WGRAVYINIQKFVQFQLTVNVVALVINFVSACASGSAPLTAVQLLWVNMIMDTLGALALATEPPHEGLMKRPPVAKGESF ITKVMWRNIIGQSIYQLIILVALNFDGKQILGLSGSDATAVLNTVIFNSFVFCQVFNEINSREMEKINVFKGMFDSWLFV GILVLTVAFQIIIVEFLGALASTVPLSWHLWLLCILIGAVSMPIAVVIKCIPVKKSEPKLQHHDGYEEIPSGPESA (SEQ ID NO: 106) |
| >XP+006421285.2 putative calcium-transporting ATPase 11, plasma membrane-type [*Citrus clementina*] MDKFLNWKDFDVEHKNPSEEALRRWRSAVSIVKNRRRRFRMVADLVKRSEGEKKKLKIQEKIRVALYVQKAALQFIDAAG RPEYKLSEETREAGFRIEPDDLAAIVRGRDIKGLKSNDGVEGVAQKLSVSLNEGVCKRDLPIRQKIYGVNRYTEKPPRSE LMFVWDALQDLTLIILIVCAVLSIGVGLATEGWPEGMYDGLGIIVSILLVVMVTAISDYKQSLQFRDLDREKKKIFIQVT RDGQRQKVSIYDLVVGDIVHLSIGDQVAADGIFISGYSLLIDESSLSGESEPMYICEENPFLLAGTKVQDGSGKMLVTTV GMRTEWGKLMETLNEGGEDETPLQVKLNGVATIIGKIGLFFSVLTFLVLAGRFLGVKAIHNEFTVWSSADALTLIDYFAV AVTIIVVAVPEGLPLAVTLSLAFAMKKLMNDRALVRHLSACETMGSASCICTDKTGTLTTNHMVVDKIWICNTISKVEGN NREAILQLEISERVLDITLQAIFQNTGSEVVKDKDGKNSILGTPTESAILEFGLRLGGDFEAQRREFKIVKVEPFNSVRK KMSVLIALPAGGMRAFCKGASEIVLSMCDKVVSDNGEPVPLSEEQFRNITDVINGFASEALRTLCLAFKDLNDSSNENNI PDSGYTLIAVVGIKDPVRPGVKEAVQTCLEAGITVRMVTGDNINTARAIAKECGILTSDGEAVEGPEFRNMSPADMKRII PKLQVMARSLPLDKHTLVTQLRKTFGEVVAVTGDGTNDAPALHEADIGLSMGIAGTEVAKGNADVIILDDNFSTIVNVAK WGRAVYINIQKFVQFQLTVNVVALVINFVSACASGSAPLTAVQLLWVNMIMDTLGALALATEPPHEGLMKRPPVAKGESF ITKVMWRNIIGQSIYQLIILVALNFDGKQILGLSGSDATAVLNTVIFNSFVFCQVFNEINSREMEKINVFKGMFDSWMFV GILVLTVAFQIIIIEFLGAFASTVPLSWHQWLLCILIGAVSMPIAVVIKCIPVKKSEPKIQHHDGYEEIPSGPESA (SEQ ID NO: 107) |
| >XP_024037041.1 calcium-transporting ATPase 4, plasma membrane-type [*Citrus clementina*] MDKFFNWKDEDVEHKNPSEEALRRWRSAASIVKNRRRRFRMVADLDKRSEAEKKKLEIKQKIQVAIDVQRAALQLTDAAG RAEYKLSEETRQAGFGIDPDDLAAIVCGHDIEGLKSNEGVEGVAQKLSVSLNEGVHKRDVPIRQNIYGVNRYTEKPPRSF FMFVWEALQDLTLIILMVCAGLSIGVGLAREGWPEGIYDGIFLVVLGIILSKFLVVMVTAISDYKQSLQFRDLDREKKKI FIQVTRDGQRQKVCTYDLVVGDIVHLSIGDQVPAYGIFISGHSLLIDESSLSGQSEPRYMYEENPFLLAGTKVQGGSGKM LVTTVGMRTEWGKLMETLNEGGEDETPLQVKLNGVATIIGKIELFFSVLEFLVLIGRFLGEKVIHNEFTDWSSADALTLI DYFAVVVTIIDVAVPEGLPLAVTLSLAFAMKKLMNDRALVRHLSACETMGSASCICTDKTRMLTTNHMVVDKIWIANTIS NVEGNNRKDILQSEISERVLDITLQAIFQNTGSEVVKDKDGKNSILGTPTESAILEFGLRLGGDFEAQRREFKIVKVEPF NSVRKKMSVLIALPAGGMRAFCKGASEIVLSMCDKVVSDNGEPVPLSEEQFRNITDVINGFASEALRTLCLAFKDLNDSS NENNIPDSGYTLIAVVGIKDPVRPGVKEAVQTCLEAGITVRMVTGNNINTARAIAKECGILTSDGEAVEGPEFRNMSPAD IIPKLQVMARSLPSDKHTLVTQLRNTFGEVVAVTGDGTNDASALHEADIGLAMGIAGTEVAKGNADVIILDDNFSTIVNV AKWGRAVYINIQKFVQFQLTVNVVALVINFVSACASGSAPLTAVQLLWVNMIMDTLGALALATEPPHEGLMKRPPVAKGE SFITKVMWRNIIGQSIYQLIILVVLNFDGKQILRLSGSDASAVLNTVIFNSFVFFQVFNEINSRDMEKINVFKGMFDSWM FVGILVLTVAFQIIIVEFLGAFASTVPLSWQLWLLCILIGAGSMPIAAVIKCVPVKKCEPKLORHD (SEQ ID NO: 108) |
| >ESR34525.1 hypothetical protein CICLE_v10004282mg [*Citrus clementina*] MFVWDALQDLTLIILIVCAVLSIGVGLATEGWPEGMYDGLGIIVSILLVVMVTAISDYKQSLQFRDLDREKKKIFIQVTR DGQRQKVSIYDLVVGDIVHLSIGDQVAADGIFISGYSLLIDESSLSGESEPMYICEENPFLLAGTKVQDGSGKMLVTTVG MRTEWGKLMETLNEGGEDETPLQVKLNGVATIIGKIGLFFSVLTFLVLAGRFLGVKAIHNEFTVWSSADALTLIDYFAVA VTIIVVAVPEGLPLAVTLSLAFAMKKLMNDRALVRHLSACETMGSASCICTDKTGTLTTNHMVVDKIWICNTISKVEGNN REAILQLEISERVLDITLQAIFQNTGSEVVKDKDGKNSILGTPTESAILEFGLRLGGDFEAQRREFKIVKVEPFNSVRKK MSVLIALPAGGMRAFCKGASEIVLSMCDKVVSDNGEPVPLSEEQFRNITDVINGFASEALRTLCLAFKDLNDSSNENNIP DSGYTLIAVVGIKDPVRPGVKEAVQTCLEAGITVRMVTGDNINTARAIAKECGILTSDGEAVEGPEFRNMSPADMKRIIP KLQVMARSLPLDKHTLVTQLRKTFGEVVAVTGDGTNDAPALHEADIGLSMGIAGTEVAKGNADVIILDDNFSTIVNVAKW GRAVYINIQKFVQFQLTVNVVALVINFVSACASGSAPLTAVQLLWVNMIMDTLGALALATEPPHEGLMKRPPVAKGESFI TKVMWRNIIGQSIYQLIILVALNFDGKQILGLSGSDATAVLNTVIFNSFVFCQVFNEINSREMEKINVFKGMFDSWMFVG ILVLTVAFQIIIIEFLGAFASTVPLSWHQWLLCILIGAVSMPIAVVIKCIPVKKSEPKIQHHDGYEEIPSGPESA (SEQ ID NO: 109) |
| >XP_006472295.1 calcium-transporting ATPase 1 [*Citrus sinensis*] MENYLNENFSDVKAKNTSEEALQRWRKLCGFVKNKKRRFRFTANLSKRFEAEAIRRSNQEKFRVAVLVSQAALQFIHGLN LSSEYTVPEEVAASGFQICPDELGSIVEGHDIKKLKVHGGVEGIAEKLSTSITDGISTSEHLLNRRKEIYGINKFTESPA RGFWVYVWEALHDMTLMILAVCALVSLVVGIATEGWPKGAHDGLGIVMSILLVVFVTATSDYKQSLQFKDLDREKKKITV QVARNGFRRKISIYDLLPGDIVHLCMGDQVPADGLFVSGFSVLINESSLTGESEPVNVNALNPFLLSGTKVQNGSCKMLV TTVGMRTQWGKLMATLSEGGDDETPLQVKLNGVATIIGKIGLFFAVVTFAVMVQGLFTRKLQEGTHWTWSGDDALEILEF FAIAVTIVVVAVPEGLPLAVTLSLAFAMKKMMNDKALVRHLAACETMGSATSICSDKTGTLTTNHMTVLKACICEEIKEV DNSKGTPAFGSSIPASASKLLLQSIFNNTGGEVVIGEGNKTEILGTPTETAILEFGLLLGGDFQAERQASKIVKVEPFNS VKKQMGVVIELPEGGFRVHCKGASEIILAACDKFLNSNGEVVPLNEAAVNHLNETIEKFASEALRTLCLAYMEIGNEFSA DAPIPTEGYTCIGIVGIKDPMRPGVKESVAICRSAGITVRMVTGDNINTAKAIARECGILTDNGIAIEGPEFREKSDEEL SKLIPKIQVMARSSPMDKHTLVKHLRTTLGEVVAVTGDGTNDAPALHEADIGLAMGIAGTEVAKESADVIILDDNFSTIV TVAKWGRSVYINIQKFVQFQLTVNVVALIVNESSACLTGNAPLTAVQLLWVNMIMDTLGALALATEPPNGDLMKRSPVGR KGNFISNVMWRNILGQSLYQFLIIWYLQTRGKAVFRLDGPDPDLILNTLIFNTFVFCQVFNEISSREMEKINVFKGILKN YVFVAVLTCTVLFQIIIIELLGTFANTTPLNLQQWFVSILLGFLGMPIAAVLKLIQVG (SEQ ID NO: 110) |
| >GAY47979.1 hypothetical protein CUMW_108500 [*Citrus unshiu*] MENYLNENFSDVKAKNTSEEALQRWRKLCGFVKNRKRRFRFTANLSKRFEAEAIRRSNQEKFRVAVLVSQAALQFIHGLN LSSEYTVPEEVAASGFQICPDELGSIVEGHDIKKLKVHGGVEGIAEKLSTSITDGISTSEHLLNRRKEIYGINKFTESPA RGFWVYVWEALHDMTLMILAVCALVSLVVGIATEGWPKGAHDGLGIVMSILLVVFVTATSDYKQSLQFKDLDREKKKITV QVARNGFRRKISIYDLLPGDIVHLCMGDQVPADGLFVSGFSVLINESSLTGESEPVNVNALNPFLLSGTKVQNGSCKMLV TTVGMRTQWGKLMATLSEGGDDETPLQVKLNGVATIIGKIGLFFAVVTFAVMVQGLFTRKLQEGTHWTWSGDDALEILEF FAIAVTIVVVAVPEGLPLAVTLSLAFAMKKMMNDKALVRHLAACETMGSATSICSDKTGTLTTNHMTVLKACICEEIKEV |

TABLE 3-continued

| Polypeptide sequence of citrus plant negative immune response regulators |
| --- |

DNSKGTPAFGSSIPASASKLLLQSIFNNTGGEVVIGEGNKTEILGTPTETAILEFGLLLGGDFQAERQASKIVKVEPFNS
VKKQMGVVIELPEGGFRVHCKGASEIILAACDKFLNSNGEVVPLNEAAVNHLNETIEKFASEALRTLCLAYMEIGNEFSA
DAPIPTEGYTCIGIVGIKDPMRPGVKESVAICRSAGITVRMVTGDNINTAKAIARECGILTDNGIAIEGPEFREKSDEEL
SKLIPKIQVMARSSPMDKHTLVKHLRTTLGEVVAVTGDGTNDAPALHEADIGLAMGIAGTEVAKESADVIILDDNFSTIV
TVAKWGRSVYINIQKFVQFQLTVNVVALIVNFSSACLTGNAPLTAVQLLWVNMIMDTLGALALATEPPNGDLMKRSPVGR
KGNFISNVMWRNILGQSLYQFLIIWYLQTRGKAVFRLDGPDPDLILNTLIFNTFVFCQVFNEISSREMEKINVFKGILKN
YVFVAVLTCTVLFQIIIIELLGTFANTTPLNLQQWFVSILLGFLGMPIAAVLKLIQVG (SEQ ID NO: 111)

>KDO78876.1 hypothetical protein CISIN_1g001775mg [*Citrus sinensis*]
MESYLQENFGVKPKHSSTEALEKWRNLCGVVKNPKRRFRFTANLSKRYEAAAMRKTNQEKLRIAVLVSKAAIQFLLGVTP
SDYNVPEEVKAAGFQVCAEELGSITEGHDVKKLKFHGGVTGIAEKLSTSISDGLTSNTDLFNRRQEIYGLNQFAESTPRS
FWVFVWEALQDMTLMILGACAFVSLIVGIVMEGWPHGAHDGLGIVASILLVVFVTATSDYRQSLQFKDLDKEKKKIYVQV
TRNGFRQKLSIYDLLPGDIVHLGIGDQVPADGLFVSGFSVLIDESSLTGESEPVMVNEENPFMLSGTKLQDGSCKMMVTT
VGMRTQWGKLMATLSEGGDDETPLQVKLNGVATIIGKGGLFFAVVTFAVLVQGLLSHKLGEGSIWSWSGDDALKLLEYFA
VAVTIVVVAVPEGLPLAVTLSLAFAMKKMMNDKALVRHLAACETMGSASSICSDKTGTLTTNHMTVVKSCICMNVKEVSK
TDSASSLCSEIPDSAVQLLLQSIFTNTGGEVVVNKDGKREILGTPTETALLEFGLSLGGDFQAERQTSKIVKVEPFNSSK
KRMGVVLELPGGGLRAHSKGASEIVLSGCDKVVNSTGEVVPLDEESLNHLKLTIDQFANEALRTLCLAFMELETGFSPEN
PIPVSGYTLIAIVGIKDPVRPGVKESVAVCRSAGITVRMVTGDNINTAKAIARECGILTDDGIAIEGPVFREKTTEELME
LIPKIQVMARSSPLDKHTLVKHLRTTFDEVVAVTGDGTNDAPALHEADIGLAMGIAGTEVAKESADVIILDDNFSTIATV
AKWGRSVYINIQKFVQFQLTVNIVALIVNFSSACLTGSAPLTAVQLLWVNMIMDTLGALALATEPPTDELMKRPPVGKRG
NFISNVMWRNILGQSLYQFMVISLLQAKGKAIFWLDGPDSTLVLNTLIFNSFVFCQIFNEISSREMEEINVFKGILDNYV
FASVLGVTVFFQIIIVEFLGTFANTTPLTLTQWFASIVIGFIGMPIAAGLKTIQV (SEQ ID NO: 112)

>XP_006433631.1 calcium-transporting ATPase 1 [*Citrus clementina*]
MENYLNENFSDVKAKNTSEEALQRWRKLCGFVKNRKRRFRFTANLSKRFEAEAIRRSNQEKERVAVLVSQAALQFIHGLN
LSSEYTVPEEVAASGFQICPDELGSIVEGHDIKKLKVHGGVEGIAEKLSTSITDGISTSEHLLNRRKEIYGINKFTESPA
RGFWVYVWEALHDMTLMILAVCALVSLVVGIATEGWPKGAHDGLGIVMSILLVVFVTATSDYKQSLQFKDLDREKKKITV
QVARNGFRRKISIYDLLPGDIVHLCMGDQVPADGLFVSGFSVLINESSLTGESEPVNVNALNPFLLSGTKVQNGSCKMLV
TTVGMRTQWGKLMATLSEGGDDETPLQVKLNGVATIIGKIGLFFAVVTFAVMVQGLFTRKLQEGTHWTWSGDDALEILEF
FAIAVTIVVVAVPEGLPLAVTLSLAFAMKKMMNDKALVRHLAACETMGSATSICSDKTGTLTTNHMTVLKACICEEIKEV
DNSKGTPAFGSSIPASASKLLLQSIFNNTGGEVVIGEGNKTEILGTPTETAILEFGLLLGGDFQAERQASKIVKVEPFNS
VKKQMGVVIELPEGGFRVHCKGASEIILAACDKFLNSNGEVVPLNEAAVNHLNETIEKFASEALRTLCLACMEIGNEFSA
DAPIPTEGYTCIGIVGIKDPMRPGVKESVAICRSAGITVRMVTGDNINTAKAIARECGILTDNGIAIEGPEFREKSDEEL
SKLIPKIQVMARSSPMDKHTLVKHLRTTLGEVVAVTGDGTNDAPALHEADIGLAMGIAGTEVAKESADVIILDDNFSTIV
TVAKWGRSVYINIQKFVQFQLTVNVVALIVNFSSACLTGNAPLTAVQLLWVNMIMDTLGALALATEPPNGDLMKRSPVGR
KGNFISNVMWRNILGQSLYQFLIIWYLQTRGKAVFRLDGPDPDLILNTLIFNTFVFCQVFNEISSREMEKINVFKGILKN
YVFVAVLTCTVLFQIIIIELLGTFANTTPLNLQQWFVSILLGFLGMPIAAVLKLIQVG (SEQ ID NO: 113)

>XP_006466431.1 calcium-transporting ATPase 2, plasma membrane-type-like [*Citrus sinensis*]
MESYLQENFGVKPKHSSTEALEKWRNLCGVVKNPKRRFRFTANLSKRYEAAAMRKTNQEKLRIAVLVSKAAIQFLLGVTP
SDYNVPEEVKAAGFQVCAEELGSITEGHDVKKLKFHGGVTGIAEKLSTSISDGLTSNTDLFNRRQEIYGLNQFAESTPRS
FWVFVWEALQDMTLMILGACAFVSLIVGIVMEGWPHGAHDGLGIVASILLVVFVTATSDYRQSLQFKDLDKEKKKIYVQV
TRNGFRQKLSIYDLLPGDIVHLGIGDQVPADGLFVSGFSVLIDESSLTGESEPVMVNEENPFMLSGTKLQDGSCKMMVTT
VGMRTQWGKLMATLSEGGDDETPLQVKLNGVATIIGKGGLFFAVVTFAVLVQGLLSHKLGEGSIWSWSGDDALKLLEYFA
VAVTIVVVAVPEGLPLAVTLSLAFAMKKMMNDKALVRHLAACETMGSASSICSDKTGTLTTNHMTVVKSCICMNIKEVSK
TDSASSLCSEIPDSAVQLLLQSIFTNTGGEVVVNKDGKREILGTPTETALLEFGLSLGGDFQAERQTSKIVKVEPFNSSK
KRMGVVLELPGGGLRAHSKGASEIVLSGCDKVVNSTGEVVPLDEESLNHLKLTIDQFANEALRTLCLAFMELETGFSPEN
PIPVSGYTLIAIVGIKDPVRPGVKESVAVCRSAGITVRMVTGDNINTAKAIARECGILTDDGIAIEGPVFREKTTEELME
LIPKIQVMARSSPLDKHTLVKHLRTTFDEVVAVTGDGTNDAPALHEADIGLAMGIAGTEVAKESADVIILDDNESTIATV
AKWGRSVYINIQKFVQFQLTVNIVALIVNFSSACLTGSAPLTAVQLLWVNMIMDTLGALALATEPPTDELMKRPPVGKRG
NFISNVMWRNILGQSLYQFMVISLLQAKGKAIFWLDGPDSTLVLNTLIFNSFVFCQIFNEISSREMEEINVFKGILDNYV
FASVLGVTVFFQIIIVEFLGTFANTTPLTLTQWFASIVIGFIGMPIAAGLKTIQV (SEQ ID NO: 114)

>XP_006426128.1 calcium-transporting ATPase 2, plasma membrane-type [*Citrus clementina*]
MESYLQENFGVKPKHSSTEALEKWRNLCGVVKNPKRRFRFTANLSKRYEAAAMRKTNQEKLRIAVLVSKAAIQFLLGVTP
SDYNVPEEVKAAGFQVCAEELGSITEGHDVKKLKFHGGVTGIAEKLSTSISDGLTSNTDLFNRRQEIYGLNQFAESTPRS
FWVFVWEALQDMTLMILGACAFVSLIVGIVMEGWPHGAHDGLGIVASILLVVFVTATSDYRQSLQFKDLDKEKKKIYVQV
TRNGFRQKLSIYDLLPGDIVHLGIGDQVPADGLFVSGFSVLIDESSLTGESEPVMVNEENPFMLSGTKLQDGSCKMMVTT
VGMRTQWGKLMATLSEGGDDETPLQVKLNGVATIIGKGGLFFAVVTFAVLVQGLLSHKLGEGSIWSWSGDDALKLLEYFA
VAVTIVVVAVPEGLPLAVTLSLAFAMKKMMNDKALVRHLAACETMGSASSICSDKTGTLTTNHMTVVKSCICMNVKEVSK
TDSASSLCSEIPDSAVQLLLQSIFTNTGGEVVVNKDGKREILGTPTETALLEFGLSLGGDFQAERQTSKIVKVEPFNSSK
KRMGVVLELPGGGLRAHSKGASEIVLSGCDKVVNSTGEVVPLDEESLNHLKLTIDQFANEALRTLCLAFMELETGFLPEN
PIPVSGYTLIAIVGIKDPVRPGVKESVAVCRSAGITVRMVTGDNINTAKAIARECGILTDDGIAIEGPVFREKTTEELME
LIPKIQVMARSSPLDKHTLVKHLRTTFDEVVAVTGDGTNDAPALHEADIGLAMGIAGTEVAKESADVIILDDNESTIATV
AKWGRSVYINIQKFVQFQLTVNIVALIVNFSSACLTGSAPLTAVQLLWVNMIMDTLGALALATEPPTDELMKRPPVGKRG
NFISNVMWRNILGQSLYQFMVISLLQAKGKAIFWLDGPDSTLELNTLIFNSFVFCQIFNEISSREMEEINVFKGILDNYV
FASVLGVTVFFQIIIVEFLGTFANTTPLTLTQWFASIVIGFIGMPIAAGLKTIQV (SEQ ID NO: 115)

>XP_024949070.1 putative calcium-transporting ATPase 11, plasma membrane-type [*Citrus sinensis*]
MDKFLNWKDFDVFHKNPSEEALRRWRSAVSIVKNPRRRFRMVADLDKRSEAEKKKLEIKVISDKDKSQATNMVACTAMAR
GFPTSQKDISPQKNLTLIILMVCAGLSIGVGLAREGWPEGIYDGLGIILSKFLVVMVTAISDYKQSLQFRDLDREKKKIF
IQVTRDGQRQKVSIYDLVVGDIVHLSIGDQVAADGIFISGHSLLIDESSLSGESEPMYIYVEKFKDGSGKMLVTTVGMRT
EWGKLMETLNEGSEDETPLQVKLNGVATIIGKIELFFSVLEFLVLVGRFLGEKVIHNEFTDWSSADALTLIDYLAVVVTL
IDVAVPEGLPLAVILSLAFAVKKLMNDGALVRHLSACEAMGSSNCICTDKTGMLTTNHMVVDKIWGHGNTISNVEGNNRE
EILQSEISERVLDITLQAIFQNTGSEVVKDKDGKNSILRTPTESTVLEFGLRLGGNFEAQRREFKIIKVEPFNSVGKRMS TABLE 3-continued

| Polypeptide sequence of citrus plant negative immune response regulators |
|---|

VLTALPEGGMRAFCKGASEIVLSMCDKVVSDNGEPVPLSEEQFRNITDVINGFASEALRTLCLAFKDLNDSSDENNIPDS
GYTLIAVVGIKDPVRPGVKEAVQTCLEAGITVRMVTGDNINTARAIAKECGILTSDGEAVEGPELRNMSPADMKRIIPKL
QVMARSLPLDKHTLVTQLRNTFGEFVAVTGDGTNDAPALHEADIGLSMGIAGTEVAKQNADVIILDDNFSTIVNVAKWGR
AVYINIQKFLQFQLTINVVINFVSACASGSAPLTAVQVLWVNMIMDTLGALALATEPPHEGLMKRPPVAKGESLITKVMW
RNIIGQCIYQLIILVVLNFDGKQLLGLSGSGATAVLNTVIFNSFVFCQLFNEINSREMEKINVFKGMFNSWMFVGILVLT
VAFQIIIVEFLGAFASTVPLRWQLWLLSILIGAVSMPIAAVIKCIPVKKCEPKLQRHD (SEQ ID NO: 116)

>KDO81510.1 hypothetical protein CISIN_1g001743mg [*Citrus sinensis*]
MENYLNENFSDVKAKNTSEEALQRWRKLCGFVKNRKRRFRFTANLSKRFEAEAIRRSNQEKFRVAVLVSQAALQFIHGLN
LSSEYTVPEEVAASGFQICPDELGSIVEGHDIKKLKVHGGVEGIAEKLSTSITDGISTSEHLLNRRKEIYGINKFTESPA
RGFWVYVWEALHDMTLMILAVCALVSLVVGIATEGWPKGAHDGLGIVMSILLVVFVTATSDYKQSLQFKDLDREKKKITV
QVARNGFRRKISIYDLLPGDIVHLCMGDQVPADGLFVSGFSVLINESSLTGESEPVNVNALNPFLLSGTKVQNGSCKMLV
TTVGMRTQWGKLMATLSEGGDDETPLQVKLNGVATIIGKIGLFFAVVTFAVMVQGLFTRKLQEGTHWTWSGDDALEILEF
FAIAVTIVVVAVPEGLPLAVTLSLAFAMKKMMNDKALVRHLAACETMGSATSICSDKTGTLTTNHMTVLKACICEEIKEV
DNSKGTPAFGSSIPASASKLLLQSIFNNTGGEVVIGEGNKTEILGTPTETAILEFGLLLGGDFQAERQASKIVKVEPFNS
VKKQMGVVIELPEGGFRVHCKGASEIILAACDKFLNSNGEVVPLNEAAVNHLNETIEKFASEALRTLCLACMEIGNEFSA
DAPIPTEGYTCIGIVGIKDPMRPGVKESVAICRSAGITVRMVTGDNINTAKAIARECGILTDNGIAIEGPEFREKSDEEL
SKLIPKIQVMARSSPMDKHTLVKHLRTTLGEVVAVTGDGTNDAPALHEADIGLAMGIAGTEVAKESADVIILDDNFSTIV
TVAKWGRSVYINIQKFVQFQLTVNVVALIVNFSSACLTGNAPLTAVQLLWVNMIMDTLGALALATEPPNGDLMKRSPVGR
KGNFISNVMWRNILGQSLYQFLIIWYLQTRGKAVFRLDGPDPDLILNTLIFNTFVFCQVCLSTCIRSTEP (SEQ ID
NO: 117)

>KDO81509.1 hypothetical protein CISIN_1g001743mg [*Citrus sinensis*]
MENYLNENFSDVKAKNTSEEALQRWRKLCGFVKNRKRRFRFTANLSKRFEAEAIRRSNQEKFRVAVLVSQAALQFIHGLN
LSSEYTVPEEVAASGFQICPDELGSIVEGHDIKKLKVHGGVEGIAEKLSTSITDGISTSEHLLNRRKEIYGINKFTESPA
RGFWVYVWEALHDMTLMILAVCALVSLVVGIATEGWPKGAHDGLGIVMSILLVVFVTATSDYKQSLQFKDLDREKKKITV
QVARNGFRRKISIYDLLPGDIVHLCMGDQVPADGLFVSGFSVLINESSLTGESEPVNVNALNPFLLSGTKVQNGSCKMLV
TTVGMRTQWGKLMATLSEGGDDETPLQVKLNGVATIIGKIGLFFAVVTFAVMVQGLFTRKLQEGTHWTWSGDDALEILEF
FAIAVTIVVVAVPEGLPLAVTLSLAFAMKKMMNDKALVRHLAACETMGSATSICSDKTGTLTTNHMTVLKACICEEIKEV
DNSKGTPAFGSSIPASASKLLLQSIFNNTGGEVVIGEGNKTEILGTPTETAILEFGLLLGGDFQAERQASKIVKVEPFNS
VKKQMGVVIELPEGGFRVHCKGASEIILAACDKFLNSNGEVVPLNEAAVNHLNETIEKFASEALRTLCLACMEIGNEFSA
DAPIPTEGYTCIGIVGIKDPMRPGVKESVAICRSAGITVRMVTGDNINTAKAIARECGILTDNGIAIEGPEFREKSDEEL
SKLIPKIQVMARSSPMDKHTLVKHLRTTLGEVVAVTGDGTNDAPALHEADIGLAMGIAGTEVAKESADVIILDDNFSTIV
TVAKWGRSVYINIQKFVQFQLTVNVVALIVNESSACLTGNAPLTAVQLLWVNMIMDTLGALALATEPPNGDLMKRSPVGR
KGNFISNVMWRNILGQSLYQFLIIWYLQTRGKAVFRLDGPDPDLILNTLIFNTFVFCQLQRDGKDKRLQGYTEELCLCSC
AHLHRSFSNNNHRAPGYICKYNSSQFATVVC (SEQ ID NO: 118)

>KDO81514.1 hypothetical protein CISIN_1g001743mg [*Citrus sinensis*]
MTLMILAVCALVSLVVGIATEGWPKGAHDGLGIVMSILLVVFVTATSDYKQSLQFKDLDREKKKITVQVARNGFRRKISI
YDLLPGDIVHLCMGDQVPADGLFVSGFSVLINESSLTGESEPVNVNALNPFLLSGTKVQNGSCKMLVTTVGMRTQWGKLM
ATLSEGGDDETPLQVKLNGVATIIGKIGLFFAVVTFAVMVQGLFTRKLQEGTHWTWSGDDALEILEFFAIAVTIVVVAVP
EGLPLAVTLSLAFAMKKMMNDKALVRHLAACETMGSATSICSDKTGTLTTNHMTVLKACICEEIKEVDNSKGTPAFGSSI
PASASKLLLQSIFNNTGGEVVIGEGNKTEILGTPTETAILEFGLLLGGDFQAERQASKIVKVEPFNSVKKQMGVVIELPE
GGFRVHCKGASEIILAACDKELNSNGEVVPLNEAAVNHLNETIEKFASEALRTLCLACMEIGNEFSADAPIPTEGYTCIG
IVGIKDPMRPGVKESVAICRSAGITVRMVTGDNINTAKAIARECGILTDNGIAIEGPEFREKSDEELSKLIPKIQVMARS
SPMDKHTLVKHLRTTLGEVVAVTGDGTNDAPALHEADIGLAMGIAGTEVAKESADVIILDDNFSTIVTVAKWGRSVYINI
QKFVQFQLTVNVVALIVNFSSACLTGNAPLTAVQLLWVNMIMDTLGALALATEPPNGDLMKRSPVGRKGNFISNVMWRNI
LGQSLYQFLIIWYLQTRGKAVFRLDGPDPDLILNTLIFNTFVFCQVFNEISSREMEKINVFKGILKNYVFVAVLTCTVLF
QIIIIELLGTFANTTPLNLQQWFVSILLGFLGMPIAAVLKLIQVG (SEQ ID NO: 119)

>GAY36889.1 hypothetical protein CUMW_025210 [*Citrus unshiu*]
MENYLKKNFDVDPKRPSEEALMRWRSAVRVVKNPRRRFRMVADLAKRAEAERKRKKLQEKLRVALYVQKAALHFIDVSNR
QNVYGFNRYAEKPARSFWMFVWEALHDLTLIILMICAAVSIGVGIPTEGWPDGVYDGLGIVLSILLVVIVTAVSDYKQSL
QFKALDKEKKNLIVQVTRDGYRKKLSIYDLVVGDIVHLSIGDQVPADGILISGYSLTIDESSLSGETEPVHINRDRPFLL
SGTKVQDGSGKMLVTSVGMRTEWGRLMVTLSEGGEDETPLQVKLNGVATVIGKIGLVFAVLTFLVLALRELVEKAQHHQI
KNWSPIDAMKLLNYFAIAVTIVVVAVPEGLPLAVTLSLAFAMKKLMNDKALVRHLSACETMGSASCICTDKTGTLTTNHM
VVTKLWICNEAKTIKSGDNEKLLKPSVSDANTGSEVVKDKDGRTNILGTPTERAILEFGLILGGDSTFHREESAIVKVEP
FNSVKKRMSVLVSLPNNGGFRVFCKGASEIILNMCDKIINADGKAVPISEEQRKNLTNVINGFSSEALRTLCLAFQDIKG
NHKAESIPENNYTLIAVVGIKDPVRPGVREAFQLTVNIVALVINFVAACITGSAPLTAVQLLWVNMIMDTLGALALATEP
PHEGLMQRPPIGRNVHFITVTMWRNIIGQSIYQIIVLGVLTFCGKKILKLSGPNATLILNTFIFNSFVFCQVFNEINSRD
MEKINVFRGIFSSWVFVAVLVATVGFQVIIVELLGTFATTVPLNWKLWLASVVIGAISMPFGVLLKCIPVGTCTSAANSK
HHDGYEPLPTGPDLA (SEQ ID NO: 120)

>KDO81511.1 hypothetical protein CISIN_1g001743mg [*Citrus sinensis*]
MENYLNENFSDVKAKNTSEEALQRWRKLCGFVKNRKRRFRFTANLSKRFEAEAIRRSNQEKFRVAVLVSQAALQFIHGLN
LSSEYTVPEEVAASGFQICPDELGSIVEGHDIKKLKVHGGVEGIAEKLSTSITDGISTSEHLLNRRKEIYGINKFTESPA
RGFWVYVWEALHDMTLMILAVCALVSLVVGIATEGWPKGAHDGLGIVMSILLVVFVTATSDYKQSLQFKDLDREKKKITV
QVARNGFRRKISIYDLLPGDIVHLCMGDQVPADGLFVSGFSVLINESSLTGESEPVNVNALNPFLLSGTKVQNGSCKMLV
TTVGMRTQWGKLMATLSEGGDDETPLQVKLNGVATIIGKIGLFFAVVTFAVMVQGLFTRKLQEGTHWTWSGDDALEILEF
FAIAVTIVVVAVPEGLPLAVTLSLAFAMKKMMNDKALVRHLAACETMGSATSICSDKTGTLTTNHMTVLKACICEEIKEV
DNSKGTPAFGSSIPASASKLLLQSIFNNTGGEVVIGEGNKTEILGTPTETAILEFGLLLGGDFQAERQASKIVKVEPENS
VKKQMGVVIELPEGGFRVHCKGASEIILAACDKFLNSNGEVVPLNEAAVNHLNETIEKFASEALRTLCLACMEIGNEFSA
DAPIPTEGYTCIGIVGIKDPMRPGVKESVAICRSAGITVRMVTGDNINTAKAIARECGILTDNGIAIEGPEFREKSDEEL
SKLIPKIQVMARSSPMDKHTLVKHLRTTLGEVVAVTGDGTNDAPALHEADIGLAMGIAGTEVAKESADVIILDDNFSTIV
TVAKWGRSVYINIQKFVQFQLTVNVVALIVNFSSACLTGK (SEQ ID NO: 121)

TABLE 3-continued

Polypeptide sequence of citrus plant negative immune response regulators

>GAY50112.1 hypothetical protein CUMW_124220 [*Citrus unshiu*]
MESYLQENFGVKPKHSSTEALEKWRNLCGVVKNPKRRFRFTANLSKRYEAAAMRKTNQEKLRIAVLVSKAAIQFLLGVTP
SDYNVPEEVKAAGFQVCAEELGSITEGHDVKKLKFHGGVTGIAEKLSTSISDGLTSNTDLFNRRQEIYGLNQFAESTPRS
FWVFVWEALQDMTLMILGACAFVSLIVGIVMEGWPHGAHDGLGIVASILLVVFVTATSDYRQSLQFKDLDKEKKKIYVQV
TRNGFRQKLSIYDLLPGDIVHLGIGDQVPADGLFVSGFSVLIDESSLTGESEPVMVNEENPFMLSGTKLQDGSCKMMVTT
VGMRTQWGKLMATLSEGGDDETPLQVKLNGVATIIGKGGLFFAVVTFAVLVQGLLSHKLGEGSIWSWSGDDALKLLEYFA
VAVTIVVVAVPEGLPLAVTLSLAFAMKKMMNDKALVRHLAACETMGSASSICSDKTGTLTTNHMTVVKSCICMNVKEVSK
TDSASSLCSEIPDSAVQLLLQSIFTNTGGEVVVNKDGKREILGTPTETALLEFGLSLGGDFQAERQTSKIVKVEPFNSSK
KRMGVVLELPGGGLRAHSKGASEIVLSGCDKVVNSTGEVVPLDEESLNHLKLTIDQFANEALRTLCLAFMELETGFLPEN
PIPVSGYTLIAIVGIKDPVRPGVKESVAVCRSAGITVRMVTGDNINTAKAIARECGILTDDGIAIEGPVFREKTTEELME
LIPKIQVMARSSPLDKHTLVKHLRTTFDEVVAVTGDGTNDAPALHEADIGLAMGIAGTEVSTLQMIS (SEQ ID NO: 122)

>KDO81512.1 hypothetical protein CISIN_1g001743mg [*Citrus sinensis*]
MENYLNENFSDVKAKNTSEEALQRWRKLCGFVKNRKRRFRFTANLSKRFEAEAIRRSNQEKFRVAVLVSQAALQFIHGLN
LSSEYTVPEEVAASGFQICPDELGSIVEGHDIKKLKVHGGVEGIAEKLSTSITDGISTSEHLLNRRKEIYGINKFTESPA
RGFWVYVWEALHDMTLMILAVCALVSLVVGIATEGWPKGAHDGLGIVMSILLVVFVTATSDYKQSLQFKDLDREKKKITV
QVARNGFRRKISIYDLLPGDIVHLCMGDQVPADGLFVSGFSVLINESSLTGESEPVNVNALNPFLLSGTKVQNGSCKMLV
TTVGMRTQWGKLMATLSEGGDDETPLQVKLNGVATIIGKIGLFFAVVTFAVMVQGLFTRKLQEGTHWTWSGDDALEILEF
FAIAVTIVVVAVPEGLPLAVTLSLAFAMKKMMNDKALVRHLAACETMGSATSICSDKTGTLTTNHMTVLKACICEEIKEV
DNSKGTPAFGSSIPASASKLLLQSIFNNTGGEVVIGEGNKTEILGTPTETAILEFGLLLGGDFQAERQASKIVKVEPFNS
VKKQMGVVIELPEGGFRVHCKGASEIILAACDKFLNSNGEVVPLNEAAVNHLNETIEKFASEALRTLCLACMEIGNEFSA
DAPIPTEGYTCIGIVGIKDPMRPGVKESVAICRSAGITVRMVTGDNINTAKAIARECGILTDNGIAIEGPEFREKSDEEL
SKLIPKIQVMARSSPMDKHTLVKHLRTTLGEVVAVTGDGTNDAPALHEADIGLAMGIAGTEVELECCCFNFSSRKTYIL
(SEQ ID NO: 123)

MPK1 protein sequences

>PtMPK1_Ptrif.0004s0435.1.v1.3.1_*Poncirus_trifoliata*
MLEKEDDLGNPRGSCQLPGSRKMFWRSASWSSSRTASQNPETEERDLADP
SGTNIVNSNGRRFPVPLTPRSQQNSKARSCLPPLQPLSIARRSLDEWPKA
SSDDVGEWHQPPTPSGNKSGERLKLDLSSIQRNSDKNGGLVKRDKIAFFD
KECSKVAEHIYLGGDAVARDRDILKQHGITHILNCVGFVCPEYFKADFVY
RTLWLQDSPSEDITSILYDVFDYFEDVREKGGRVFVHCCQGVSRSTSLVI
AYLMWREGQSFDDAFQYVKAARGIADPNMGFACQLLQCQKRVHAFPLSPS
SLLRMYRIAPHSPYDPLHLVPKMLNDPTPSALDSRGAFIVHIPAAIYIWI
GKHCESIMERDARGAVCQLVRYERAQGRIVIIKEGEEPGYFWDAFSNFLP
LMDKSRNGVEIRESTIKMVPGERKVNSYDVDYEIFRKAIMGGFVPPFSSS
ENEHETHLPARESSWSALRRKFASGDMKEFVSVPKISLCRVYSESMMLVH
SSSPSSSTSSLLSSSSSPPYLSPDSLCSDSSTSSKCSSESSMDSPSAASC
SLPVSSTLSNFSNLSLHSFKNSSEDIPNKPETCGSQPPLSPVKRISPSLA
ERRGSLSKSLKLPVMTSNVRANSSLDLLASQEDGASRSDNTYTLCNSDSI
DIVFKSKSAIRNGEEDATQMCKLKISPSSVDTAELCHKVSSSANNCVDSG
RNYSWREGLKANRLDESVPDHCNQMQPLIYRWPTFERVGKFDLSALNSKS
AFAIFSPSRDSGKSAARVLYFWVGRSFCHGKSQIQLDNNKELGNIEGSDQ
NQFGYDILTRMGLPKDTPIKIVKEDEEPREFLALLSAP- (SEQ ID NO: 124)

>XP_006436100.1 protein-tyrosine-phosphatase MKP1 [*Citrus clementina*]
MLEKEDDLGNPRGSCQLPGSRKMFWRSASWSSSRTASQNPETEERDLADPSGSNIVNSNGRRFPVPLTPRSQQNSKARSC
LPPLQPLSIARRSLDEWPKASSDDVGEWHQPPTPSGNKSGERLKLDLSSIQRNSDKNGGLVKRDKIAFFDKECSKVAEHI
YLGGDAVARDRDILKQHGITHILNCVGFVCPEYFKADFVYRTLWLQDSPSEDITSILYDVFDYFEDVREKGGRVFVHCCQ
GVSRSTSLVIAYLMWREGQSFDDAFQYVKAARGIADPNMGFACQLLQCQKRVHAFPLSPSSLLRMYRIAPHSPYDPLHLV
PKMLNDPTPLALDSRGAFIVHIPAAIYIWIGKHCESIMERDARGAVCQLVRYERAQGRIVIIKEGEEPGYFWDAFSNFLP
LMDKSRNGVEIRESTIKMVPGERKVNSYDVDYEIFRKAIMGGFVPPFSSSENEHETHLPARESSWSALRRKFASGDMKEF
VSVPKISLCRVYSESMMLVHSSSPSSSTSSLLSSSSSPPYLSPDSVCSDSSTSSKCSSESSMDSPSAASCSLPVSSTLSI
FSNLSLHSFKNSSEDNKPETCGSQPPLSPVKRISPSLAERRGSLSKSLKLPVMTSNVRANSSLDLLASQEDVASRSDNTY
TLCNSDSIDIVFKSKSAIRNGEEDATQMCKLKISPSSVDTAELCHKVSSSANNCVDSGRNYSWREGLKANRLDESVPDHC
NQMQPLIYRWPTFERVGKEDSSALNSKSAFAIFSPSRDSGKSAARVLYFWVGRSFCHGKSPIQLDNNKELGNIEGSDQNQ
FGYDILTRMGLPKDTPIKIIKEDEEPREFLALLSTP (SEQ ID NO: 125)

>XP_006486024.1 protein-tyrosine-phosphatase MKP1 [*Citrus sinensis*]
MLEKEDDLGNPRGSCQLPGSRKMFWRSASWSSSRTASQNPETEERDLADPSGSNIVNSNGRRFPVPLTPRSQQNSKARSC
LPPLQPLSIARRSLDEWPKASSDDVGEWHQPPTPSGNKSGERLKLDLSSIQRNSDKNGGLVKRDKIAFFDKECSKVAEHI
YLGGDAVARDRDILKQHGITHILNCVGFVCPEYFKADFVYRTLWLQDSPSEDITSILYDVFDYFEDVREKGGRVFVHCCQ
GVSRSTSLVIAYLMWREGQSFDDAFQYVKAARGIADPNMGFACQLLQCQKRVHAFPLSPSSLLRMYRIAPHSPYDPLHLV
PKMLNDPTPLALDSRGAFIVHIPAAIYIWIGKHCESIMERDARGAVCQLVRYERAQGRIVIIKEGEEPGYFWDAFSNFLP
LMDKSRNGVEIRESTIKMVPGERKVNSYDVDYEIFRKAIMGGFVPPESSSENEHETHLPARESSWSALRRKFASGDMKEF
VSVPKISLCRVYSESMMLVHSSSPSSSTSSLLSSSSSPPYLSPDSVCSDSSTSSKCSSESSMDSPSAASCSLPVSSTLSI
FSNLSLHSFKNSSEDNKPETCGSQPPLSPVKRISPSLAERRGSLSKSLKLPVMTSNVRANSSLDLLASQEDVASRSDNTY
TLCNSDSIDIVFKSKSAIRNGEEDATQMCKLKISPSSVDTAELCHKVSSSANNCVDSGRNYSWREGLKANRLDESVPDHC
NQMQPLIYRWPTFERVGKEDSSALNSKSAFAIFSPSRDSGKSAARVLYFWVGRSFCHGESPIQLDNNKELGNIEGSDQNQ
FGYDILTRMGLPKDTPIKIIKEDEEPREFLALLSTP (SEQ ID NO: 126)

>KDO67766.1 hypothetical protein CISIN_1g0032231mg, partial [*Citrus sinensis*]
MLEKEDDLGNPRGSCQLPGSRKMFWRSASWSSSRTASQNPETEERDLVDPSGSNIVNSNGRRFPVPLTPRSQQNSKARSC
LPPLQPLSIARRSLDEWPKASSDDVGEWHQPPTPSGNKSGERLKLDLSSIQRNSDKNGGLVKRDKIAFFDKECSKVAEHI
YLGGDAVARDRDILKQHGITHILNCVGFVCPEYFKADFVYRTLWLQDSPSEDITSILYDVFDYFEDVREKGGRVFVHCCQ
GVSRSTSLVIAYLMWREGQSFDDAFQYVKAARGIADPNMGFACQLLQCQKRVHAFPLSPSSLLRMYRIAPHSPYDPLHLV TABLE 3-continued

| Polypeptide sequence of citrus plant negative immune response regulators |
|---|
| PKMLNDPTPSALDSRGAFIVHIPAAIYIWIGKHCESIMERDARGAVCQLVRYERAQGRIVIIKEGEEPGYFWDAFSNFLP LMDKSRNGVEIRESTIKMVPGERKVNSYDVDYEIFRKAIMGGFVPPFSSSENEHETHLPARESSWSALRRKFASGDMKEF VSVPKISLCRVYSESMMLVHSSSPSSSTSSLLSSSSSPPYLSPDSVCSDSSTSSKCSSESSMDSPSAASCSLPVSSTLSN FSNLSLRSFKNSSEDIPNKPETCGSQPPLSPVKRISPSLAERRGSLSKSLKLPVMTSNVRANSSLDLLASQEDVASRSDN TYTLCNSDSIDIVFKSKSAIRNGEEDATQMCKLKISPSSVDTAELCHKVSSSANNCVDSGRNYSWREGLKANRLDESVPD HCNQMQPLIYRWPTFERVGKEDSSALNSKSAFAIFSPSRDSGKSAARVLYFWVGRSFCHGKSRIQLDNNKELGNIEGSDQ NQFGYDILTRMGLPKDTPIK (SEQ ID NO: 127) |
| >XP_006483970.1 protein-tyrosine-phosphatase MKP1-like isoform X2 [*Citrus sinensis*] MVGEEDNNKHVDRLSGGSGNRRAYLRSVSWTDRSPNKPNPIPRPQPNSKARSLLPPLQPLSINRRPVEQWPRAGSDDLGV WPNPQTPRGSVQLNPLESSSSELQPVKEFEFKKDKLAFFDKECSRIADHIYLGSDAVAKNRGILRQNGITHVLNCVGFVC PEYFKGDLVYKTLWLQDSPSEDITSILYDVFDYFEDVREQGGRVFVHCCQGVSRSTSLVIAYLMWREGQSFEDAFQDVKA ARGVTNPNMGFACQLLLCQKRVHAMPASPNSMLRIYRIAPHSSYDPLHLVPKLLNYPVAQGFDTRGAFIVLVPSAIYVWI GKNCSVMMSNRAREAANQVIRYEKAQGQITSIKEGEEPLEFWDALVRGQFFADGCNKEEVKNEQVSFSGSNKIATLMQDG AGEIDEYDLDFELFHKALDGGVVPPFSVSNAGSETCVPARESGWCRLRRKFVNGLMREFVASKLNCATSAVNDESNMIID TGKASEDAVSLAGFASPSSPPADVCGSPDSFDCFPNVSPNRISPQLSSKSPTLSPSTSDYSSSFTFSPSSCNWSDLSRQP SPSGLEATDSSHSLCEETAFSLSKVFSPNHTSGVANSCFPCKGNFPSIAERRGSNPPPRLLPSAGKPSIVPRNLVRSWSF SLTDLENDEVKDMDNNQIVHEGDREELMLNADLACASNDSHDKIKDKKEYDRVHFSLGTIDKRMGVANPVLYQWPALSKV ESSSFQVLDSRSVYILLAPDTSLGTNESGILYVWLGCEVLCEKGQSQLVSNNCTCKHGHLQLETIGHNIINQMGLPADAS VQIVREGEEPEQFLNHLNCESFQKASNSANH (SEQ ID NO: 128) |
| >XP_006483969.1 protein-tyrosine-phosphatase MKP1-like isoform X1 [*Citrus sinensis*] MVGEEDNNKHVDRLSGGSGNRRAYLRSVSWTDRSPNKPNPIPRPQPNSKARSLLPPLQPLSINRRPVEQWPRAGSDDLGV WPNPQTPRGSVQLNPLESSSSELQPVKEFEFKKDKLAFFDKECSRIADHIYLGSDAVAKNRGILRQNGITHVLNCVGFVC PEYFKGDLVYKTLWLQDSPSEDITSILYDVFDYFEDVREQGGRVFVHCCQGVSRSTSLVIAYLMWREGQSFEDAFQDVKA ARGVTNPNMGFACQLLLCQKRVHAMPASPNSMLRIYRIAPHSSYDPLHLVPKLLNYPVAQGFDTRGAFIVLVPSAIYVWI GKNCSVMMSNRAREAANQVIRYEKAQGQITSIKEGEEPLEFWDALVRGQFFADGCNKEEVKNEQVSFSGSNKIATLMQDG AGEIDEYDLDFELFHKALDGGVVPPFSVSNAGSETCVPARESGWCRLRRKFVNGLMREFVASKLNCATSAVNDESNMIID TGKASEDAVSLAGFASPSSPPADVCGSPDSFDCFPNVSPNRISSPQLSSKSPTLSPSTSDYSSSFTFSPSSCNWSDLSRQ PSPSGLEATDSSHSLCEETAFSLSKVFSPNHTSGVANSCFPCKGNFPSIAERRGSNPPPRLLPSAGKPSIVPRNLVRSWS FSLTDLENDEVKDMDNNQIVHEGDREELMLNADLACASNDSHDKIKDKKEYDRVHFSLGTIDKRMGVANPVLYQWPALSK VESSSFQVLDSRSVYILLAPDTSLGTNESGILYVWLGCEVLCEKGQSQLVSNNCTCKHGHLQLETIGHNIINQMGLPADA SVQIVREGEEPEQFLNHLNCFSFQKASNSANH (SEQ ID NO: 129) |

| CRT1 protein sequences |
|---|
| >PtCRT1_Ptrif.0005s1608.1.v1.3.1_*Poncirus_trifoliata* MAKLNPSFLSLTLLTIFLTIASAHVFFEERFDDGWESRWVKSDWKTDENT AGEWNYTAGKWNGDPNDKGIQTSEDYRFYAISAEFPEFSNKDKTLVFQFS VKHEQKLDCGGGYMKLLSGEVDQKKFGGDTPYSIMFGPDICGYSTKKVHA ILTYNGTNKLIKKEVPCETDQLTHVYTFILRPDASYSILIDNVEKQSGSL YSDWDLLPPKTIKDPDAKKPEDWDDKEYIPDPEDKKPEGYDDIPKEITDP DAKKPDDWDDEEDGEWTAPTIPNPEYKGPWKPKKIKNPNYKGKWKAPMID NPDFKDDPDLYVYPNLKYVGIELWQVKSGTMFDNVLVSDDPEYAKKLAEE TWGKHKDAEKAAFDEAEKKREEEESKDAPDSDAEDNDDDTEDDDDADAD ADAETKSDSSSGDSDKDVHDEL- (SEQ ID NO: 130) |
| >XP_006433523.1 calreticulin [*Citrus clementina*] MAKLNPSFLSLTLLTIFLTIASAHVFFEERFDDGWESRWVTSDWKKDENTAGEWNYTAGKWNGDPNDKGIQTSEDYRFYA ISAEFPEFSNKDKTLVFQFSVKHEQKLDCGGGYMKLLSGEVDQKKFGGDTPYSIMFGPDICGYSTKKVHAILTYNGTNKL IKKEVPCETDQLTHVYTFILRPDATYSILIDNVEKQSGSLYSDWDLLPPKTIKDPDAKKPEDWDDKEYIPDPEDKKPEGY DDIPKEITDPDAKKPDDWDDEEDGEWTAPTIPNPEYKGPWKPKKIKNPNYKGKWKAPMIDNPDFKDDPDLYVYPNLKYVG IELWQVKSGTMFDNVLVSDDPEYANKLAEETWGKHKDAEKAAFDEAEKKREEEESKDAPDSDAEDNDDDTEDDDDADTE TKSDSSSGDADKDVHDEL (SEQ ID NO: 131) |
| >GAY54380.1 hypothetical protein CUMW_156290, partial [*Citrus unshiu*] YIQSSFTPHSTEHFLSLALKMAKLNPSFLSLTLLTIFLTIASAHVFFEERFDDGWESQWVKSDWKKDENTAGEWNYTAGK WNGDPNDKGIQTSEDYRFYAISAEFPEFSNKDKTLVFQFSVKHEQKLDCGGGYMKLLSGEVDQKKFGGDTPYSIMFGPDI CGYSTKKVHAILTYNGTNKLIKKEVPCETDQLTHVYTFILRPDATYSILIDNVEKQSGSLYSDWDLLPPKTIKDPDAKKP EDWDDKEYIPDPEDKKPEGYDDIPKEITDPDAKKPDDWDDEEDGEWTAPTIPNPEYKGPWKPKKIKNPNYKGKWKAPMID NPDFKDDPDLYVYPNLKYVGIELWQVKSGTMEDNVLVSDDPEYANKLAEETWGKHKDAEKAAFDEAEKKREEENEQIVKK PEPPPAPSPVRSLNALKIGAYATTRSAAGEPVPYSSNVVKKHVPESVANNGSYRCSESLLLRRPDEFLCPLD (SEQ ID NO: 132) |
| >ESR46762.1 hypothetical protein CICLE_v10001298mg [*Citrus clementina*] MAKLNPSFLSLTLLTIFLTIASAHVFFEERFDDGWESRWVTSDWKKDENTAGEWNYTAGKWNGDPNDKGIQTSEDYRFYA ISAEFPEFSNKDKTLVFQFSVKHEQKLDCGGGYMKLLSGEVDQKKFGGDTPYSIMFGPDICGYSTKKVHAILTYNGTNKL IKKEVPCETDQLTHVYTFILRPDATYSILIDNVEKQSGSLYSDWDLLPPKTIKDPDAKKPEDWDDKEYIPDPEDKKPEGY DDIPKEITDPDAKKPDDWDDEEDGEWTAPTIPNPEYKGPWKPKKIKNPNYKGKWKAPMIDNPDFKDDPDLYVYPNLKYVG IELWQVKSGTMEDNVLVSDDPEYANKLAEETWGKHKDV (SEQ ID NO: 133) |
| >GAY54381.1 hypothetical protein CUMW_156280, partial [*Citrus unshiu*] YIQSSFTPHSTEHFLSLALKMAKLNPSFLSLTLLTIFLTIASAHVFFEERFDDGWESQWVKSDWKKDENTAGEWNYTAGK WNGDPNDKGIQTSEDYRFYAISAEFPEFSNKDKTLVFQFSVKHEQKLDCGGGYMKLLSGEVDQKKFGGDTPYSIMFGPDI CGYSTKKVHAILTYNGTNKLIKKEVPCETDQLTHVYTFILRPDATYSILIDNVEKQSGSLYSDWDLLPPKTIKDPDAKKP EDWDDKEYIPDPEDKKPEGYDDIPKEITDPDAKKPDDWDDEEDGEWTAPTIPNPEYKGPWKPKKIKNPNYKGKWKAPMID |

TABLE 3-continued

| Polypeptide sequence of citrus plant negative immune response regulators |
|---|

NPDFKDDPDLYVYPNLKYVGIELWQVKSGTMFDNVLVSDDPEYANKLAEETWGKHKDAEKAAFDEAEKKREEEVLFCSIT
LLHILFFLWNWVFSILS (SEQ ID NO: 134)

>GAY54382.1 hypothetical protein CUMW_156290, partial [*Citrus unshiu*]
YIQSSFTPHSTEHFLSLALKMAKLNPSFLSLTLLTIFLTIASAHVFFEEREDDGWESQWVKSDWKKDENTAGEWNYTAGK
WNGDPNDKGIQTSEDYRFYAISAEFPEFSNKDKTLVFQFSVKHEQKLDCGGGYMKLLSGEVDQKKFGGDTPYSIMFGPDI
CGYSTKKVHAILTYNGTNKLIKKEVPCETDQLTHVYTFILRPDATYSILIDNVEKQSGSLYSDWDLLPPKTIKDPDAKKP
EDWDDKEYIPDPEDKKPEGYDDIPKEITDPDAKKPDDWDDEEDGEWTAPTIPNPEYKGPWKPKKIKNPNYKGKWKAPMID
NPDFKDDPDLYVYPNLKYVGIELWQVKSGTMEDNVLVSDDPEYANKLAEETWGKHKDV (SEQ ID NO: 135)

>XP_006472186.1 calreticulin [*Citrus sinensis*]
MAKLNPSSLSLTLLIIFLTIASAHVFFEERFDDGWESQWVKSDWKKDENTAGEWNYTAGKWNGDPNDKGIQTSEDYRFYA
ISAEFPEFSNKDKTLVFQFSVKHEQKLDCGGGYMKLLSGEVDQKKFGGDTPYSIMFGPDICGYSTKKVHAILTYNGTNKL
IKKEVPCETDQLTHVYTFILRPDATYSILIDNAEKQSGSLYSDWDLLPPKTIKDPDAKKPEDWDDKEYIPDPEDKKPEGY
DDIPKEITDPDAKKPDDWDDEEDGEWTAPTIPNPEYKGPWKPKKIKNPNYKGKWKAPMIDNPDFKDDPDLYVYPNLKYVG
IELWQVKSGTMFDNVLVSDDPEYAKKLAEETWGKHKDAEKAAFDEAEKKREEEESKDAPDSDAEDNDDDDTEDDDDADAE
TKSDSSSGDADKDVHDEL (SEQ ID NO: 136)

>KDO81693.1 hypothetical protein CISIN_1g0453962mg, partial [*Citrus sinensis*]
MAKLNPSELSLTLLTIFLTIASAHVFFEEREDDGWESRWVTSDWKKDENTAGEWNYTAGKWNGDPNDKGIQTSEDYRFYA
ISAEFPEFSNKDKTLVFQFSVKHEQKLDCGGGYMKLLSGEVDQKKFGGDTPYSIMFGPDICGYSTKKVHAILTYNGTNKL
IKKEVPCETDQLTHVYTFILRPDATYSILIDNAEKQSGSLYSDWDLLPPKTIKDPDAKKPEDWDDKEYIPDPEDKKPEGY
DDIPKEITDPDAKKPDDWDDEEDGEWTAPTIPNPEYKGPWKPK (SEQ ID NO: 137)

| LIN2 (HEMF1) protein sequences |
|---|

>PtLIN2_Ptrif.0006s1200.1.v1.3.1_*Poncirus_trifoliata*
MPPTTTVSASSSFTLFRVPSSSSTKLKPTTTYIQIPNRFFPKHPTFKMTT
TTIRAAVSIEKETPETERPPTFLRESDDKESSSSSASSVRARFEKMIRDA
QDSVCQAIEKTDGGGKFKEDVWSRPGGGGGISRVLQDGAIWEKAGVNVSV
VYGVMPPEAYRAAKAAASDEKPGPIPFFAAGISSVLHPKNPFAPTLHFNY
RYFETDAPKDTPGAPRQWWFGGGTDLTPAYIFEEDVKHFHSTQKSACDKF
DPTFYPRFKKWCDDYFYIKHRGERRGLGGIFFDDLNDYDQEMLLSFATEC
ANSVIPAYIPIIEKRKDTPFTDQHKAWQQLRRGRYVEFNLVYDRGTTFGL
KTGGRIESILVSLPLTARWEYDHNPEEGSEEWKLLDACINPKEWI- (SEQ ID NO: 138)

>XP_006429803.1 oxygen-dependent coproporphyrinogen-III oxidase, chloroplastic
[*Citrus clementina*]
MPPTTAVSASSSFTLFRVPSSSSTKLKPTTTYIQIPNRFFPKHPTFKMTTTTIRAAVSIEKETPETERPPTFLRESDDKE
SSSSSASSVRARFEKMIRDAQDSVCQAIEKTDGGGKFKEDVWSRPGGGGGISRVLQDGAIWEKAGVNVSVVYGVMPPEAY
RAAKAAASDEKPGPIPFFAAGISSVLHPKNPFAPTLHFNYRYFETDAPKDTPGAPRQWWFGGGTDLTPAYIFEEDVKHFH
STQKSACDKFDPTFYPRFKKWCDDYFYIKHRGERRGLGGLFFDDLNDYDQEMLLSFATECANSVIPAYIPIIEKRKDTPF
TDQHKAWQQLRRGRYVEFNLVYDRGTTFGLKTGGRIESILVSLPLTARWEYDHNPKEGSEEWKLLDACINPKEWI (SEQ
ID NO: 139)

>XP_006492904.1 oxygen-dependent coproporphyrinogen-III oxidase, chloroplastic
isoform X2 [*Citrus sinensis*]
MPPTTAVSASSSFTLFRVPSSWSTKLKPTTTYIQIPNRFFPKHPTFKMTTTTIRAAVSIEKETPETERPPTFLRESDDKE
SSSSSASSVRARFEKMIRDAQDSVCQAIEKTDGGGKFKEDVWSRPGGGGGISRVLQDGAIWEKAGVNVSVVYGVMPPEAY
RAAKAAASDEKPGPIPFFAAGISSVLHPKNPFAPTLHFNYRYFETDAPKDTPGAPRQWWFGGGTDLTPAYIFEEDVKHFH
STQKSACDKFDPTFYPRFKKWCDDYFYIKHRGERRGLGGLFFDDLNDYDQEMLLSFATECANSVIPAYIPIIEKRKDTPF
TDQHKAWQQLRRGRYVEFNLVYDRGTTFGLKTGGRIESILVSLPLTARWEYDHNPKEGSEEWKLLDACINPKEWI (SEQ
ID NO: 140)

>KDO50201.1 hypothetical protein CISIN_1g014082mg [*Citrus sinensis*]
MPPTTAVSASSSFTLFRVPSSWSTKLKPTTTYIQIPNRFFPKHPTFKMTTTTIRAAVSIEKETPETERPPTFLRESDDKE
SSSSSASSVRARFEKMIRDAQDSVCQAIEKTDGGGKFKEDVWSRPGGGGGISRVLQDGAIWEKAGVNVSVVYGVMPPEAY
RAAKAAASDEKPGPIPFFAAGISSVLHPKNPFAPTLHFNYRYFETDAPKDTPGAPRQWWFGGGTDLTPAYIFEEDVKHFH
STQKSACDKFDPTFYPRFKKWCDDYFYIKHRGERRGLGGLFFDDLNDYDQEMLLSFATECANSVIPAYIPIIEKRKDTPF
TDQHKAWQQLRRGRYVEFNLVYDRGTTFGLKTGGRIESILVSLPLTARWEYDHVSFLEHSGEYASDVTKSLKSWTDEGSF
FFFSLFSMQNPKEGSEEWKLLDACINPKEWI (SEQ ID NO: 141)

>XP_024949038.1 oxygen-dependent coproporphyrinogen-III oxidase, chloroplastic
isoform X1 [*Citrus sinensis*]
MPPTTAVSASSSFTLFRVPSSWSTKLKPTTTYIQIPNRFFPKHPTFKMTTTTIRAAVSIEKETPETERPPTFLRESDDKE
SSSSSASSVRARFEKMIRDAQDSVCQAIEKTDGGGKFKEDVWSRPGGGGGISRVLQDGAIWEKAGVNVSVVYGVMPPEAY
RAAKAAASDEKPGPIPFFAAGISSVLHPKNPFAPTLHFNYRYFETDAPKDTPGAPRQWWFGGGTDLTPAYIFEEDVKHFH
STQKSACDKFDPTFYPRFKKWCDDYFYIKHRGERRGLGGLFFDDLNDYDQEMLLSFATECANSVIPAYIPIIEKRKDTPF
TDQHKAWQQLRRGRYVEFNLVYDRGTTFGLKTGGRIESILVSLPLTARWEYDHVSELEHSGEYASDVTKSLKSWTDEGSF
FFFFLVEYAEPERGK (SEQ ID NO: 142)

>KDO50203.1 hypothetical protein CISIN_1g014082mg [*Citrus sinensis*]
MPPTTAVSASSSFTLFRVPSSWSTKLKPTTTYIQIPNRFFPKHPTFKMTTTTIRAAVSIEKETPETERPPTFLRESDDKE
SSSSSASSVRARFEKMIRDAQDSVCQAIEKTDGGGKFKEDVWSRPGGGGGISRVLQDGAIWEKAGVNVSVVYGVMPPEAY
RAAKAAASDEKPGPIPFFAAGISSVLHPKNPFAPTLHFNYRYFETDAPKDTPGAPRQWWFGGGTDLTPAYIFEEDVKHFH
STQKSACDKFDPTFYPRFKKWCDDYFYIKHRGERRGLGGLFFDDLNDYDQEMLLSFATECANSVIPAYIPIIEKRKDTPF
TDQHKAWQQLRRGRYVEENLVSNSPED (SEQ ID NO: 143)

TABLE 3-continued

| Polypeptide sequence of citrus plant negative immune response regulators |
|---|
| CRWN (LINC4) protein sequences |

>PtCRWN_Ptrif.0007s0608.1.v1.3.1_*Poncirus_trifoliata*
MASPTSGRLAITPSSRVLQSPLSDESIWKRLKEAGFDEESIKRRDKAALI
AYIAKLETEIFEHQHHMGLLILEKKELASKYEQIKASAEAAELLQKHDQA
SHLSAIAEARKREESLKKTLGVEKECIASLEKAVHEIRAESAETKVAADS
KFAEARCMVENAQKKFAEAEAKLHAAEPLQAEANRYHRSAERKLQEVVAR
EDDLSRRIASFKADCEEKEREIIRERQSLSDRKKILQQEHERLLDAQTLL
NEREDHILSKLQELSRKEKELEASRANVEEKFKALNEEKSNLDLTLVSLS
KREEAVIEREASLQKKEQKLLVSQETLASKESNEIQKIIANHESALRVKQ
SEFEAELAIKYKLAEDEIEKKRRAWELRDLDLSQREESLLEREHDLEVQS
RALVDKEKDLVERSHLLEEKENKLIAFEKEADLKKSLLQKEKEEVNIIKS
DLQKSLSSLDEKKKQLNCAKDKLEAMKSEAGELSVLEIKLKEELDVVRAQ
KLELMVETDKLELEKAKFEAEWEMIDEKREELRKEAERVAVERVVVSKSL
KDERDSLRQERDAMRDQHKRDVDSLNREREEFMNKMVHEHSEWFTKIQQE
RADFLLGIEMQKRDLENCIEKRREELESSFREREKAFEEEKMRELQQISS
LKEKAEKELEQVTLEIKRLDLERMEINMDRQRRDREWAELNNSIEELKVQ
RQKLKEQRQLLHADREEIQAESERLKKLEDLKIAVDYMAVSEMQRSRLEH
SQKKISAKRHLNQQTSVAHADFGSDQKFDVTNNGDRFNTPSVQKTASASP
PSLARFSWIKRFADLVFKHSGENSVENDEEKSPTSDHEDASLTINSRKRQ
PVRYSFGFPKVILEVPSENEVVKRTVDLESENNQNAAQKCKQSVSEDGIH
AARKRRVDVDCVDPSELLMQNNKRRKQQEDFPRNSSEEAINHGAVAEQSN
LPEDQHTLTSKNKSNVPEGLHTLTSNNHIQGGNEEASILIVDKIIKISEV
TCEMTDADNFINQEKIDGSQNSVAESVQDIVKVGGTNDHSTSAHTDDVIL
PYVSEIDGMGQEKQMGNVKDLTECGQAQNE (SEQ ID NO: 144)

>ESR39398.1 hypothetical protein CICLE_v10024751mg [*Citrus clementina*]
MASPSSGRLSITPSSRVLQSPLSDESIWKRLKEAGLDEESIKRRDKAALIAYIAKLETEIFEHQHHMGLLILEKKELASK
YEQIKASAEAAELLQKHDQASHLSAIAEARKREESLKKTLGVEKECIASLEKAVHEIRAESAETKVAADSKFAEARCMVE
NAQKKFAEAEAKLHASESLQAEANRYHRSAERKLQDVVAREDDLSRRIASFKADCEEKEREIIRERQSLSDRKKILQQEH
ERLLDAQTLLNEREDHILSKLQELSRKEKELEASRANVEEKFKALNEEKSNLDLTLVSLLKREEAVIEREASLQKKEQKL
LVSQETLASKESNEIQKIIANHESALRVKQSEFEAELAIKYKLAEDEIEKKRRAWELRDLDLGQREESLLEREHDLEVOS
RALVDKEKDLVERSHLLEEKENKLIAFEKEADLKKSLLQKEKEEVNIIKSDLQKSLSSLDEKKKQVNCAKDKLEAMKSEA
GELSVLEIKLKEELDVVRAQKLELMVETDKLQLEKAKFEAEWEMIDEKREELRKEAESVAVERVVVSKSLKDERDSLRQE
RDAMRDQHKRDVDSLNREREEFMNKMVHEHSEWFTKIQQERADELLGIEMQKRDLENCIEKRREELESSFREREKAFEEE
KMRELQQISSLKEKAEKELEQVTLEIKRLDLERMEINMDRQRRDREWAELNNSIEELKVQRQKLEEQRQLLHADREEIQA
ESERLKKLEDLKIAVDYMAVSEMQRSRLEHSQKKISAKRHLNQQTSLAHADLGSDQKFDVTNNGDRFNTPSVQKTASASP
PSLARFSWIKRFADLVEKHSGENSIENDEEKSPTSDHEDASLTINSRKRQPVRYSFGEPKVILEVPSENEVVKRTVDLES
ENNQNAAQKCKQSVSEDGIHAARKRRVDVDCVDPSELLMQNNKRRKQQEDFPRNSSEEAINHGAVAEQSNLPEDQHTLTS
KNKSNVPEGLHTLTSNNHTQGGNEEASILIVDKIIKISEVTCEMPDADNFINQEKIDGSQNSVAESVQDIVKVGGTNDHS
TPAHTDDVVLPYVSEIDGMVQEKQMGNVKDLTECGQAQVLMFLHTSFLYIILAYDSCSLFLHDLLVCLYDGISCFC (SEQ
ID NO: 145)

>KDO78822.1 hypothetical protein CISIN_1g001119mg [*Citrus sinensis*]
MASPSSGRLAITPSSRVLQSPLSDESIWKRLKEAGLDEVSIKRRDKAALIAYIAKLETEIFEHQHHMGLLILEKKELASK
YEQIKASAEAAELLQKHDRASHLSAIAEARKREESLKKTLGVEKECIASLEKAVHEIRAESAETKVAADSKFAEARCMVE
NAQKKFAEAEAKLHAAESLQAEANRYHRSAERKLQDVVAREDDLSRRIASFKADCEEKEREIIRERQSLSDRKKILQQEH
ERLLDAQTLLNEREDHILSKLQELSRKEKELEASRANVEEKFKALNEEKSNLDLTLVSLLKREEAVIEREASLQKKEQKL
LVSQETLASKESNEIQKIIANHESALRVKQSEFEAELAIKYKLAEDEIEKKRRAWELRDLDLGQREESLLEREHDLEVQS
RALVDKEKDLVERSHLLEEKENKLIAFEKEADLKKSLLQKEKEEVNIIKSDLQKSLSSLDEKKKQVNCAKDKLEAMKSEA
GELSVLEIKLKEELDVVRAQKLELMVETDKLQLEKAKFEAEWEMIDEKREELRKEAERVAVERVVVSKSLKDERDSLRQE
RDAMRDQHKRDVDSLNREREEFMNKMVHEHSEWFTKIQQERADELLGIEMQKRDLENCIEKRREELESSFREREKAFEEE
KMREFQQISSLKEKAEKELEQVTLEIKRLDLERMEINMDRQRRDREWAELNNSIEELMVQRQKLEEQRQLLHADREEIQA
ESERLKKLEDLKIAVDYMAVSEMQRSRLEHSQKKISAKRHLNQQTSLAHADLGSDQKFDVTNNGDRFNTPSVQKTASASP
PSLARFSWIKRFADLVEKHSGENSVENDEEKSPTSDHEDASLTINSRKRQPVRYSFGEPKVILEVPSENEVVKRTVDLES
ENNQNAAQKCKQSVSEDGIHAARKRRVDVDCVDPSELLMQNNKRRKQQEDFPRNSSEEAINHGAVAEQSNLPEDQHTLTS
KNKSNVPEGLHTLTSNNHTQGGNEEASILIVDKIIKISEVTCEMTDADNFINQEKIDGSQNSVAESVQDIVKVGGTNDHS
TPAHTDDVVLPYISEIDGMVQEKQMGNVKDLTECGQAQVLMFLHTSFLYIILAYDSCSLFLHDLLVCLYDGISYFC (SEQ
ID NO: 146)

>XP_006426157.1 protein CROWDED NUCLEI 4 isoform X2 [*Citrus clementina*]
MASPSSGRLSITPSSRVLQSPLSDESIWKRLKEAGLDEESIKRRDKAALIAYIAKLETEIFEHQHHMGLLILEKKELASK
YEQIKASAEAAELLQKHDQASHLSAIAEARKREESLKKTLGVEKECIASLEKAVHEIRAESAETKVAADSKFAEARCMVE
NAQKKFAEAEAKLHASESLQAEANRYHRSAERKLQEVVAREDDLSRRIASFKADCEEKEREIIRERQSLSDRKKILQQEH
ERLLDAQTLLNEREDHILSKLQELSRKEKELEASRANVEEKFKALNEEKSNLDLTLVSLLKREEAVIEREASLQKKEQKL
LVSQETLASKESNEIQKIIANHESALRVKQSEFEAELAIKYKLAEDEIEKKRRAWELRDLDLGQREESLLEREHDLEVQS
RALVDKEKDLVERSHLLEEKENKLIAFEKEADLKKSLLQKEKEEVNIIKSDLQKSLSSLDEKKKQVNCAKDKLEAMKSEA
GELSVLEIKLKEELDVVRAQKLELMVETDKLQLEKAKFEAEWEMIDEKREELRKEAESVAVERVVVSKSLKDERDSLRQE
RDAMRDQHKRDVDSLNREREEFMNKMVHEHSEWFTKIQQERADFLLGIEMQKRDLENCIEKRREELESSFREREKAFEEE
KMRELQQISSLKEKAEKELEQVTLEIKRLDLERMEINMDRQRRDREWAELNNSIEELKVQRQKLEEQRQLLHADREEIQA TABLE 3-continued

| Polypeptide sequence of citrus plant negative immune response regulators |
|---|

ESERLKKLEDLKIAVDYMAVSEMQRSRLEHSQKKISAKRHLNQQTSLAHADLGSDQKEDVTNNGDRFNTPSVQKTASASP
PSLARFSWIKRFADLVEKHSGENSIENDEEKSPTSDHEDASLTINSRKRQPVRYSFGEPKVILEVPSENEVVKRTVDLES
ENNQNAAQKCKQSVSEDGIHAARKRRVDVDCVDPSELLMQNNKRRKQQEDFPRNSSEEAINHGAVAEQSNLPEDQHTLTS
KNKSNVPEGLHTLTSNNHTQGGNEEASILIVDKIIKISEVTCEMPDADNFINQEKIDGSQNSVAESVQDIVKVGGTNDHS
TPAHTDDVVLPYVSEIDGMVQEKQMGNVKDLTECGQAQNEIGEHKLECELVQSDNSKKNKELIAYRTRSKQKK (SEQ
ID NO: 147)

>KDO78816.1 hypothetical protein CISIN_1g001119mg [*Citrus sinensis*]
MASPSSGRLAITPSSRVLQSPLSDESIWKRLKEAGLDEVSIKRRDKAALIAYIAKLETEIFEHQHHMGLLILEKKELASK
YEQIKASAEAAELLQKHDRASHLSAIAEARKREESLKKTLGVEKECIASLEKAVHEIRAESAETKVAADSKFAEARCMVE
NAQKKFAEAEAKLHAAESLQAEANRYHRSAERKLQEVVAREDDLSRRIASFKADCEEKEREIIRERQSLSDRKKILQQEH
ERLLDAQTLLNEREDHILSKLQELSRKEKELEASRANVEEKFKALNEEKSNLDLTLVSLLKREEAVIEREASLQKKEQKL
LVSQETLASKESNEIQKIIANHESALRVKQSEFEAELAIKYKLAEDEIEKKRRAWELRDLDLGQREESLLEREHDLEVQS
RALVDKEKDLVERSHLLEEKENKLIAFEKEADLKKSLLQKEKEEVNIIKSDLQKSLSSLDEKKKQVNCAKDKLEAMKSEA
GELSVLEIKLKEELDVVRAQKLELMVETDKLQLEKAKFEAEWEMIDEKREELRKEAERVAVERVVVSKSLKDERDSLRQE
RDAMRDQHKRDVDSLNREREEFMNKMVHEHSEWFTKIQQERADFLLGIEMQKRDLENCIEKRREELESSFREREKAFEEE
KMREFQQISSLKEKAEKELEQVTLEIKRLDLERMEINMDRQRRDREWAELNNSIEELMVQRQKLEEQRQLLHADREEIQA
ESERLKKLEDLKIAVDYMAVSEMQRSRLEHSQKKISAKRHLNQQTSLAHADLGSDQKEDVTNNGDRFNTPSVQKTASASP
PSLARFSWIKRFADLVFKHSGENSVENDEEKSPTSDHEDASLTINSRKRQPVRYSFGEPKVILEVPSENEVVKRTVDLES
ENNQNAAQKCKQSVSEDGIHAARKRRVDVDCVDPSELLMQNNKRRKQQEDFPRNSSEEAINHGAVAEQSNLPEDQHTLTS
KNKSNVPEGLHTLTSNNHTQGGNEEASILIVDKIIKISEVTCEMTDADNFINQEKIDGSQNSVAESVQDIVKVGGTNDHS
TPAHTDDVVLPYISEIDGMVQEKQMGNVKDLTECGQAQNEMGEHKLECELVQSDNSKKNKELIAYRTRSKQKK (SEQ
ID NO: 148)

>XP_024035967.1 protein CROWDED NUCLEI 4 isoform X1 [*Citrus clementina*]
MASPSSGRLSITPSSRVLQSPLSDESIWKRLKEAGLDEESIKRRDKAALIAYIAKLETEIFEHQHHMGLLILEKKELASK
YEQIKASAEAAELLQKHDQASHLSAIAEARKREESLKKTLGVEKECIASLEKAVHEIRAESAETKVAADSKFAEARCMVE
NAQKKFAEAEAKLHASESLQAEANRYHRSAERKLQDVVAREDDLSRRIASFKADCEEKEREIIRERQSLSDRKKILQQEH
ERLLDAQTLLNEREDHILSKLQELSRKEKELEASRANVEEKFKALNEEKSNLDLTLVSLLKREEVYTISFPFLELNLVLI
CFHVLFTGNYIKYDSSIECTQAVIEREASLQKKEQKLLVSQETLASKESNEIQKIIANHESALRVKQSEFEAELAIKYKL
AEDEIEKKRRAWELRDLDLGQREESLLEREHDLEVQSRALVDKEKDLVERSHLLEEKENKLIAFEKEADLKKSLLQKEKE
EVNIIKSDLQKSLSSLDEKKKQVNCAKDKLEAMKSEAGELSVLEIKLKEELDVVRAQKLELMVETDKLQLEKAKFEAEWE
MIDEKREELRKEAESVAVERVVVSKSLKDERDSLRQERDAMRDQHKRDVDSLNREREEFMNKMVHEHSEWFTKIQQERAD
FLLGIEMQKRDLENCIEKRREELESSFREREKAFEEEKMRELQQISSLKEKAEKELEQVTLEIKRLDLERMEINMDRQRR
DREWAELNNSIEELKVQRQKLEEQRQLLHADREEIQAESERLKKLEDLKIAVDYMAVSEMQRSRLEHSQKKISAKRHLNQ
QTSLAHADLGSDQKEDVTNNGDRFNTPSVQKTASASPPSLARFSWIKRFADLVFKHSGENSIENDEEKSPTSDHEDASLT
INSRKRQPVRYSFGEPKVILEVPSENEVVKRTVDLESENNQNAAQKCKQSVSEDGIHAARKRRVDVDCVDPSELLMQNNK
RRKQQEDFPRNSSEEAINHGAVAEQSNLPEDQHTLTSKNKSNVPEGLHTLTSNNHTQGGNEEASILIVDKIIKISEVTCE
MPDADNFINQEKIDGSQNSVAESVQDIVKVGGTNDHSTPAHTDDVVLPYVSEIDGMVQEKQMGNVKDLTECGQAQNEIGE
HKLECELVQSDNSKKNKELIAYRTRSKQKK (SEQ ID NO: 149)

>KDO78814.1 hypothetical protein CISIN_1g001119mg [*Citrus sinensis*]
MASPSSGRLAITPSSRVLQSPLSDESIWKRLKEAGLDEVSIKRRDKAALIAYIAKLETECYILKIFEHQHHMGLLILEKK
ELASKYEQIKASAEAAELLQKHDRASHLSAIAEARKREESLKKTLGVEKECIASLEKAVHEIRAESAETKVAADSKFAEA
RCMVENAQKKFAEAEAKLHAAESLQAEANRYHRSAERKLQEVVAREDDLSRRIASFKADCEEKEREIIRERQSLSDRKKI
LQQEHERLLDAQTLLNEREDHILSKLQELSRKEKELEASRANVEEKFKALNEEKSNLDLTLVSLLKREEAVIEREASLQK
KEQKLLVSQETLASKESNEIQKIIANHESALRVKQSEFEAELAIKYKLAEDEIEKKRRAWELRDLDLGQREESLLEREHD
LEVQSRALVDKEKDLVERSHLLEEKENKLIAFEKEADLKKSLLQKEKEEVNIIKSDLQKSLSSLDEKKKQVNCAKDKLEA
MKSEAGELSVLEIKLKEELDVVRAQKLELMVETDKLQLEKAKFEAEWEMIDEKREELRKEAERVAVERVVVSKSLKDERD
SLRQERDAMRDQHKRDVDSLNREREEFMNKMVHEHSEWFTKIQQERADFLLGIEMQKRDLENCIEKRREELESSFREREK
AFEEEKMREFQQISSLKEKAEKELEQVTLEIKRLDLERMEINMDRQRRDREWAELNNSIEELMVQRQKLEEQRQLLHADR
EEIQAESERLKKLEDLKIAVDYMAVSEMQRSRLEHSQKKISAKRHLNQQTSLAHADLGSDQKEDVTNNGDRFNTPSVQKT
ASASPPSLARFSWIKRFADLVFKHSGENSVENDEEKSPTSDHEDASLTINSRKRQPVRYSFGEPKVILEVPSENEVVKRT
VDLESENNQNAAQKCKQSVSEDGIHAARKRRVDVDCVDPSELLMQNNKRRKQQEDFPRNSSEEAINHGAVAEQSNLPEDQ
HTLTSKNKSNVPEGLHTLTSNNHTQGGNEEASILIVDKIIKISEVTCEMTDADNFINQEKIDGSQNSVAESVQDIVKVGG
TNDHSTPAHTDDVVLPYISEIDGMVQEKQMGNVKDLTECGQAQNEMGEHKLECELVQSDNSKKNKELIAYRTRSKQKK
(SEQ ID NO: 150)

>KDO78821.1 hypothetical protein CISIN_1g001119mg [*Citrus sinensis*]
MASPSSGRLAITPSSRVLQSPLSDESIWKRLKEAGLDEVSIKRRDKAALIAYIAKLETEIFEHQHHMGLLILEKKELASK
YEQIKASAEAAELLQKHDRASHLSAIAEARKREESLKKTLGVEKECIASLEKAVHEIRAESAETKVAADSKFAEARCMVE
NAQKKFAEAEAKLHAAESLQAEANRYHRSAERKLQEVVAREDDLSRRIASFKADCEEKEREIIRERQSLSDRKKILQQEH
ERLLDAQTLLNEREDHILSKLQELSRKEKELEASRANVEEKFKALNEEKSNLDLTLVSLLKREEAVIEREASLQKKEQKL
LVSQETLASKESNEIQKIIANHESALRVKQSEFEAELAIKYKLAEDEIEKKRRAWELRDLDLGQREESLLEREHDLEVQS
RALVDKEKDLVERSHLLEEKENKLIAFEKEADLKKSLLQKEKEEVNIIKSDLQKSLSSLDEKKKQVNCAKDKLEAMKSEA
GELSVLEIKLKEELDVVRAQKLELMVETDKLQLEKAKFEAEWEMIDEKREELRKEAERVAVERVVVSKSLKDERDSLRQE
RDAMRDQHKRDVDSLNREREEFMNKMVHEHSEWFTKIQQERADELLGIEMQKRDLENCIEKRREELESSFREREKAFEEE
KMREFQQISSLKEKAEKELEQVTLEIKRLDLERMEINMDRQRRDREWAELNNSIEELMVQRQKLEEQRQLLHADREEIQA
ESERLKKLEDLKIAVDYMAVSEMQRSRLEHSQKKISAKRHLNQQTSLAHADLGSDQKFDVTNNGDRFNTPSVQKTASASP
PSLARFSWIKRFADLVFKHSGENSVENDEEKSPTSDHEDASLTINSRKRQPVRYSFGEPKVILEVPSENEVVKRTVDLES
ENNQNAAQKCKQSVSEDGIHAARKRRVDVDCVDPSELLMQNNKRRKQQEDFPRNSSEEAINHGAVAEQSNLPEDQHTLTS
KNKSNVPEGLHTLTSNNHTQGGNEEASILIVDKIIKISEVTCEMTDADNFINQEKIDGSQNSVAESVQDIVKVGGTNDHS
TPAHTDDVVLPYISEIDGMVQEKQMGNVKDLTECE (SEQ ID NO: 151)

>XP_006466411.1 protein CROWDED NUCLEI 4 isoform X2 [*Citrus sinensis*]
MASPSSGRLAITPSSRVLQSPLSDESIWKRLKEAGLDEVSIKRRDKAALIAYIAKLETEIFEHQHHMGLLILEKKELASK
YEQIKASAEAAELLQKHDRASHLSAIAEARKREESLKKTLGVEKECIASLEKAVHEIRAESAETKVAADSKFAEARCMVE
NAQKKFAEAEAKLHAAESLQAEANRYHRSAERKLQEVVAREDDLSRRIASFKADCEEKEREIIRERQSLSDRKKILQQEH TABLE 3-continued

| Polypeptide sequence of citrus plant negative immune response regulators |
|---|

ERLLDAQTLLNEREDHILSKLQELSRKEKELEASRANVEEKFKALNEEKSNLDLTLVSLLKREEAVIEREASLQKKEQKL
LVSQETLASKESNEIQKIIANHESALRVKQSEFEAELAIKYKLAEDEIEKKRRAWELRDLDLSQREESLLEREHDLEVQS
RALVDKEKDLVERSHLLEEKENKLIAFEKEADLKKSLLQKEKEEVNIIKSDLQKSLSSLDEKKKQVNCAKDKLEAMKSEA
GELSVLEIKLKEELDVVRAQKLELMVETDKLQLEKAKFEAEWEMIDEKREELRKEAERVAVERVVVSKSLKDERDSLRQE
RDAMRDQHKRDVDSLNREREEFMNKMVHEHSEWFTKIQQERADFLLGIEMQKRDLENCIEKRREELESSFREREKAFEEE
KMREFQQISSLKEKAEKELEQVTLEIKRLDLERMEINMDRQRRDREWAELNNSIEELMVQRQKLEEQRQLLHADREEIQA
ESERLKKLEDLKIAVDYMAVSEMQRSRLEHSQKKISAKRHLNQQTSLAHADEGSDQKFDVTNNGDRFNTPVQKTASASPP
SLARFSWIKRFADLVEKHSGENSVENDEEKSPTSDHEDASLTINSRKRQPVRYSFGEPKVILEVPSENEVVKRTVDLESE
NNQNAAQKCKQSVSEDGIHAARKRRVDVDCVDPSELLMQNNKRRKQQEDFPRDSSEEAINHGAVAEQSNLPEDQHTLTSK
NKSNVPEGLHTLTSNNHTQGGNEEASILIVDKIIKISEVTCEMTDADNFINQEKIDGSQNSVAESVQDIVKVGGTNDHST
PAHTDDVVLPYISEIDGMVQEKQMGNVKDLTECGQAQNEMGEHKLECELVQSDNSKKNKELIAYRTRSKQKK (SEQ ID
NO: 152)

>KDO78820.1 hypothetical protein CISIN_1g001119mg [*Citrus sinensis*]
MASPSSGRLAITPSSRVLQSPLSDESIWKRLKEAGLDEVSIKRRDKAALIAYIAKLETEIFEHQHHMGLLILEKKELASK
YEQIKASAEAAELLQKHDRASHLSAIAEARKREESLKKTLGVEKECIASLEKAVHEIRAESAETKVAADSKFAEARCMVE
NAQKKEAEAEAEAKLHAAESLQAEANRYHRSAERKLQEVVAREDDLSRRIASFKADCEEKEREIIRERQSLSDRKKILQQEH
ERLLDAQTLLNEREDHILSKLQELSRKEKELEASRANVEEKFKALNEEKSNLDLTLVSLLKREEAVIEREASLQKKEQKL
LVSQETLASKESNEIQKIIANHESALRVKQSEFEAELAIKYKLAEDEIEKKRRAWELRDLDLGQREESLLEREHDLEVQS
RALVDKEKDLVERSHLLEEKENKLIAFEKEADLKKSLLQKEKEEVNIIKSDLQKSLSSLDEKKKQVNCAKDKLEAMKSEA
GELSVLEIKLKEELDVVRAQKLELMVETDKLQLEKAKFEAEWEMIDEKREELRKEAERVAVERVVVSKSLKDERDSLRQE
RDAMRDQHKRDVDSLNREREEFMNKMVHEHSEWETKIQQERADFLLGIEMQKRDLENCIEKRREELESSFREREKAFEEE
KMREFQQISSLKEKAEKELEQVTLEIKRLDLERMEINMDRQRRDREWAELNNSIEELMVQRQLLHADREEIQAESERLKK
LEDLKIAVDYMAVSEMQRSRLEHSQKKISAKRHLNQQTSLAHADLGSDQKFDVTNNGDRFNTPSVQKTASASPPSLARFS
WIKRFADLVFKHSGENSVENDEEKSPTSDHEDASLTINSRKRQPVRYSFGEPKVILEVPSENEVVKRTVDLESENNQNAA
QKCKQSVSEDGIHAARKRRVDVDCVDPSELLMQNNKRRKQQEDFPRNSSEEAINHGAVAEQSNLPEDQHTLTSKNKSNVP
EGLHTLTSNNHTQGGNEEASILIVDKIIKISEVTCEMTDADNFINQEKIDGSQNSVAESVQDIVKVGGTNDHSTPAHTDD
VVLPYISEIDGMVQEKQMGNVKDLTECGQAQNEMGEHKLECELVQSDNSKKNKELIAYRTRSKQKK (SEQ ID NO:
153)

>GAY50146.1 hypothetical protein CUMW_124490 [*Citrus unshiu*]
MASPSSGRLSITPSSRVLQSPLSDESIWKRLKEAGLDEESIKRRDKAALIAYIAKLETECYILKIFEHQHHMGLLILEKK
ELASKYEQIKASAEAAELLQKHDQASHLSAIAEARKREESLKKTLGVEKECIASLEKAVHEIRAESAETKVAADSKFAEA
RCMVENAQKKFAEAEAKLHASESLQAEANRYHRSAERKLQEVVAREDDLSRRIASFKAHCEEKEREIIRERQSLSDRKKI
LQQEHERLLDAQTLLNEREDHILSKLQELSRKEKELEASRANVEEKFKALNEEKSNLDLTLVSLLKREEAVIEREASLQK
KEQKLLVSQETLASKESNEIQKIIANHESALRVKQSEFEAELAIKYKLAEDEIEKKRRAWELRDLDLGQREESLLEREHD
LEVQSRALVDREKDLVERSHLLEEKENKLIAFEKEADLKKSLLQKEKEEVNIIKSDLQKSLSSLDEKKKQVNCAKDKLEA
MKSEAGELSVLEIKLKEELDVVRAQKLELMVETDKLQLEKAKFEAEWEMIDEKREELRKEAERVAVERVVVSKSLKDERD
SLRQERDAMRDQHKRDVDSLNREREEFMNKMVHEHSEWFTKIQQERADFLLGIEMQKRDLENCIEKRREELESSFREREK
GFEEEKMREFQQISSLKEKAEKELEQVTLEIKRLDLERMEINMDRQRRDREWAELNNSIEELKVQRQKLEEQRQLLHADR
EEIQAESERLKKLEDLKIAVDYMAVSEMQRSRLEHSQKKISAKRHLNQQTSLAHADFGSDQKFDVTNNGDRFNTPVQKTA
SASPPSLARFSWIKRFADLVEKHSGENSVENDEEKSPTSDHEDASLTINSRKRQPVRYSFGEPKVILEVPSENEVVKRTV
DLESENNQNAAQKCKQSVSEDGIHAARKRRVDVDCVDPSELPMQNNKRRKQQEDFPRDSSEEAINHGAVAEQSNLPEDQH
TLTSKNKSNVPEGLHTLTSNNHTQGGNEEASILIVDKIIKISEVTCEMPDADNFINQEKIDGSQNSVAESVQDIVKVGGT
NDHSTPAHTDDVVLPYVSEIDGMVQEKQMGNVKDLTECGQAQYAGLFVTSLGGDCLKSMYADPGTFDLFFEVNVVDPLGG
DGKTALFGGGGEANGKCEGDAYNHYVREGDKDRLGYFAERPAITCAAAALPYLLLVECWVPGIFLYLLSPCVDSCSLFLH
DLLNEMGEHKLECELVQSDNSKKNKELIAYRTRSKQKK (SEQ ID NO: 154)

>KDO78815.1 hypothetical protein CISIN_1g001119mg [*Citrus sinensis*]
MASPSSGRLAITPSSRVLQSPLSDESIWKRLKEAGLDEVSIKRRDKAALIAYIAKLETEIFEHQHHMGLLILEKKELASK
YEQIKASAEAAELLQKHDRASHLSAIAEARKREESLKKTLGVEKECIASLEKAVHEIRAESAETKVAADSKFAEARCMVE
NAQKKFAEAEAKLHAAESLQAEANRYHRSAERKLQEVVAREDDLSRRIASFKADCEEKEREIIRERQSLSDRKKILQQEH
ERLLDAQTLLNEREDHILSKLQELSRKEKELEASRANVEEKFKALNEEKSNLDLTLVSLLKREEVYTISFPFLFLNLVLI
CFHVLFTGNYIKYDSSIECTQAVIEREASLQKKEQKLLVSQETLASKESNEIQKIIANHESALRVKQSEFEAELAIKYKL
AEDEIEKKRRAWELRDLDLGQREESLLEREHDLEVQSRALVDKEKDLVERSHLLEEKENKLIAFEKEADLKKSLLQKEKE
EVNIIKSDLQKSLSSLDEKKKQVNCAKDKLEAMKSEAGELSVLEIKLKEELDVVRAQKLELMVETDKLQLEKAKFEAEWE
MIDEKREELRKEAERVAVERVVVSKSLKDERDSLRQERDAMRDQHKRDVDSLNREREEFMNKMVHEHSEWFTKIQQERAD
FLLGIEMQKRDLENCIEKRREELESSFREREKAFEEEKMREFQQISSLKEKAEKELEQVTLEIKRLDLERMEINMDRQRR
DREWAELNNSIEELMVQRQKLEEQRQLLHADREEIQAESERLKKLEDLKIAVDYMAVSEMQRSRLEHSQKKISAKRHLNQ
QTSLAHADLGSDQKFDVTNNGDRFNTPSVQKTASASPPSLARFSWIKRFADLVEKHSGENSVENDEEKSPTSDHEDASLT
INSRKRQPVRYSFGEPKVILEVPSENEVVKRTVDLESENNQNAAQKCKQSVSEDGIHAARKRRVDVDCVDPSELLMQNNK
RRKQQEDFPRNSSEEAINHGAVAEQSNLPEDQHTLTSKNKSNVPEGLHTLTSNNHTQGGNEEASILIVDKIIKISEVTCE
MTDADNFINQEKIDGSQNSVAESVQDIVKVGGTNDHSTPAHTDDVVLPYISEIDGMVQEKQMGNVKDLTECGQAQNEMGE
HKLECELVQSDNSKKNKELIAYRTRSKQKK (SEQ ID NO: 155)

>GAY50145.1 hypothetical protein CUMW_124490 [*Citrus unshiu*]
MASPSSGRLSITPSSRVLQSPLSDESIWKRLKEAGLDEESIKRRDKAALIAYIAKLETECYILKIFEHQHHMGLLILEKK
ELASKYEQIKASAEAAELLQKHDQASHLSAIAEARKREESLKKTLGVEKECIASVRYHQDHCLVELEKAVHEIRAESAET
KVAADSKFAEARCMVENAQKKFAEAEAKLHASESLQAEANRYHRSAERKLQEVVAREDDLSRRIASFKAHCEEKEREIIR
ERQSLSDRKKILQQEHERLLDAQTLLNEREDHILSKLQELSRKEKELEASRANVEEKFKALNEEKSNLDLTLVSLLKREE
AVIEREASLQKKEQKLLVSQETLASKESNEIQKIIANHESALRVKQSEFEAELAIKYKLAEDEIEKKRRAWELRDLDLGQ
REESLLEREHDLEVQSRALVDREKDLVERSHLLEEKENKLIAFEKEADLKKSLLQKEKEEVNIIKSDLQKSLSSLDEKKK
QVNCAKDKLEAMKSEAGELSVLEIKLKEELDVVRAQKLELMVETDKLQLEKAKFEAEWEMIDEKREELRKEAERVAVERV
VVSKSLKDERDSLRQERDAMRDQHKRDVDSLNREREEFMNKMVHEHSEWFTKIQQERADELLGIEMQKRDLENCIEKRRE
ELESSFREREKGFEEEKMREFQQISSLKEKAEKELEQVTLEIKRLDLERMEINMDRQRRDREWAELNNSIEELKVQRQKL
EEQRQLLHADREEIQAESERLKKLEDLKIAVDYMAVSEMQRSRLEHSQKKISAKRHLNQQTSLAHADFGSDQKFDVTNNG
DRFNTPVQKTASASPPSLARESWIKRFADLVFKHSGENSVENDEEKSPTSDHEDASLTINSRKRQPVRYSFGEPKVILEV
PSENEVVKRTVDLESENNQNAAQKCKQSVSEDGIHAARKRRVDVDCVDPSELPMQNNKRRKQQEDFPRDSSEEAINHGAV TABLE 3-continued

| Polypeptide sequence of citrus plant negative immune response regulators |
|---|

AEQSNLPEDQHTLTSKNKSNVPEGLHTLTSNNHTQGGNEEASILIVDKIIKISEVTCEMPDADNFINQEKIDGSQNSVAE
SVQDIVKVGGTNDHSTPAHTDDVVLPYVSEIDGMVQEKQMGNVKDLTECGQAQYAGLFVTSLGGDCLKSMYADPGTFDLF
FEVNVVDPLGGDGKTALFGGGGEANGKCEGDAYNHYVREGDKDRLGYFAERPAITCAAAALPYLLLVECWVPGIFLYLLS
PCVDSCSLFLHDLLNEMGEHKLECELVQSDNSKKNKELIAYRTRSKQKK (SEQ ID NO: 156)

>XP_006466410.1 protein CROWDED NUCLEI 4 isoform X1 [*Citrus sinensis*]
MASPSSGRLAITPSSRVLQSPLSDESIWKRLKEAGLDEVSIKRRDKAALIAYIAKLETEIFEHQHHMGLLILEKKELASK
YEQIKASAEAAELLQKHDRASHLSAIAEARKREESLKKTLGVEKECIASLEKAVHEIRAESAETKVAADSKFAEARCMVE
NAQKKFAEAEAKLHAAESLQAEANRYHRSAERKLQEVVAREDDLSRRIASFKADCEEKEREIIRERQSLSDRKKILQQEH
ERLLDAQTLLNEREDHILSKLQELSRKEKELEASRANVEEKFKALNEEKSNLDLTLVSLLKREEVYMISFPFLELNLVLI
CFHVFFTGNYIKYDSSIECTQAVIEREASLQKKEQKLLVSQETLASKESNEIQKIIANHESALRVKQSEFEAELAIKYKL
AEDEIEKKRRAWELRDLDLSQREESLLEREHDLEVQSRALVDKEKDLVERSHLLEEKENKLIAFEKEADLKKSLLQKEKE
EVNIIKSDLQKSLSSLDEKKKQVNCAKDKLEAMKSEAGELSVLEIKLKEELDVVRAQKLELMVETDKLQLEKAKFEAEWE
MIDEKREELRKEAERVAVERVVVSKSLKDERDSLRQERDAMRDQHKRDVDSLNREREEFMNKMVHEHSEWFTKIQQERAD
FLLGIEMQKRDLENCIEKRREELESSFREREKAFEEEKMREFQQISSLKEKAEKELEQVTLEIKRLDLERMEINMDRQRR
DREWAELNNSIEELMVQRQKLEEQRQLLHADREEIQAESERLKKLEDLKIAVDYMAVSEMQRSRLEHSQKKISAKRHLNQ
QTSLAHADFGSDQKEDVTNNGDRFNTPVQKTASASPPSLARFSWIKRFADLVFKHSGENSVENDEEKSPTSDHEDASLTI
NSRKRQPVRYSFGEPKVILEVPSENEVVKRTVDLESENNQNAAQKCKQSVSEDGIHAARKRRVDVDCVDPSELLMQNNKR
RKQQEDFPRDSSEEAINHGAVAEQSNLPEDQHTLTSKNKSNVPEGLHTLTSNNHTQGGNEEASILIVDKIIKISEVTCEM
TDADNFINQEKIDGSQNSVAESVQDIVKVGGTNDHSTPAHTDDVVLPYISEIDGMVQEKQMGNVKDLTECGQAQNEMGEH
KLECELVQSDNSKKNKELIAYRTRSKQKK (SEQ ID NO: 157)

>GAY50148.1 hypothetical protein CUMW_124490 [*Citrus unshiu*]
MASPSSGRLSITPSSRVLQSPLSDESIWKRLKEAGLDEESIKRRDKAALIAYIAKLETECYILKIFEHQHHMGLLILEKK
ELASKYEQIKASAEAAELLQKHDQASHLSAIAEARKREESLKKTLGVEKECIASLEKAVHEIRAESAETKVAADSKFAEA
RCMVENAQKKEAEAEAKLHASESLQAEANRYHRSAERKLQEVVAREDDLSRRIASFKAHCEEKEREIIRERQSLSDRKKI
LQQEHERLLDAQTLLNEREDHILSKLQELSRKEKELEASRANVEEKFKALNEEKSNLDLTLVSLLKREEVYMISFPFLEL
NLVLICFHVFFTGNYIKYDSSIECTQAVIEREASLQKKEQKLLVSQETLASKESNEIQKIIANHESALRVKQSEFEAELA
IKYKLAEDEIEKKRRAWELRDLDLGQREESLLEREHDLEVQSRALVDREKDLVERSHLLEEKENKLIAFEKEADLKKSLL
QKEKEEVNIIKSDLQKSLSSLDEKKKQVNCAKDKLEAMKSEAGELSVLEIKLKEELDVVRAQKLELMVETDKLQLEKAKF
EAEWEMIDEKREELRKEAERVAVERVVVSKSLKDERDSLRQERDAMRDQHKRDVDSLNREREEFMNKMVHEHSEWFTKIQ
QERADFLLGIEMQKRDLENCIEKRREELESSFREREKGFEEEKMREFQQISSLKEKAEKELEQVTLEIKRLDLERMEINM
DRQRRDREWAELNNSIEELKVQRQKLEEQRQLLHADREEIQAESERLKKLEDLKIAVDYMAVSEMQRSRLEHSQKKISAK
RHLNQQTSLAHADFGSDQKFDVTNNGDRFNTPVQKTASASPPSLARFSWIKRFADLVFKHSGENSVENDEEKSPTSDHED
ASLTINSRKRQPVRYSFGEPKVILEVPSENEVVKRTVDLESENNQNAAQKCKQSVSEDGIHAARKRRVDVDCVDPSELPM
QNNKRRKQQEDFPRDSSEEAINHGAVAEQSNLPEDQHTLTSKNKSNVPEGLHTLTSNNHTQGGNEEASILIVDKIIKISE
VTCEMPDADNFINQEKIDGSQNSVAESVQDIVKVGGTNDHSTPAHTDDVVLPYVSEIDGMVQEKQMGNVKDLTECGQAQY
AGLFVTSLGGDCLKSMYADPGTFDLFFEVNVVDPLGGDGKTALFGGGGEANGKCEGDAYNHYVREGDKDRLGYFAERPAI
TCAAAALPYLLLVECWVPGIFLYLLSPCVDSCSLFLHDLLNEMGEHKLECELVQSDNSKKNKELIAYRTRSKQKK (SEQ
ID NO: 158)

>KDO78818.1 hypothetical protein CISIN_1g001119mg [*Citrus sinensis*]
MASPSSGRLAITPSSRVLQSPLSDESIWKRLKEAGLDEVSIKRRDKAALIAYIAKLETEIFEHQHHMGLLILEKKELASK
YEQIKASAEAAELLQKHDRASHLSAIAEARKREESLKKTLGVEKECIASLEKAVHEIRAESAETKVAADSKFAEARCMVE
NAQKKFAEAEAKLHAAESLQAEANRYHRSAERKLQEVVAREDDLSRRIASFKADCEEKEREIIRERQSLSDRKKILQQEH
ERLLDAQTLLNEREDHILSKLQELSRKEKELEASRANVEEKFKALNEEKSNLDLTLVSLLKREEAVIEREASLQKKEQKL
LVSQETLASKESNEIQKIIANHESALRVKQSEFEAELAIKYKLAEDEIEKKRRAWELRDLDLGQREESLLEREHDLEVQS
RALVDKEKDLVERSHLLEEKENKLIAFEKEADLKKSLLQKEKEEVNIIKSDLQKSLSSLDEKKKQVNCAKDKLEAMKSEA
GELSVLEIKLKEELDVVRAQKLELMVETDKLQLEKAKFEAEWEMIDEKREELRKEAERVAVERVVVSKSLKDERDSLRQE
RDAMRDQHKRDVDSLNREREEFMNKMVHEHSEWFTKIQQERADFLLGIEMQKRDLENCIEKRREELESSFREREKAFEEE
KMREFQQISSLKEKAEKELEQVTLEIKRLDLERMEINMDRQRRDREWAELNNSIEELMVQRQKLEEQRQLLHADREEIQA
ESERLKKLEDLKIAVDYMAVSEMQRSRLEHSQKKISAKRHLNQQTSLAHADLGSDQKFDVTNNGDRFNTPSVQKTASASP
PSLARFSWIKRFADLVFKHSGENSVENDEEKSPTSDHEDASLTINSRKRQPVRYSFGEPKVILEVPSENEVVKRTVDLES
ENNQNAAQKCKQSVSEDGIHAARKRRVDVDCVDPSELLMQNNKRRKQQEDFPRNSSEEAINHGAVAEQSNLPEDQHTLTS
KNKSNVPEGLHTLTSNNHTQGEKIDGSQNSVAESVQDIVKVGGTNDHSTPAHTDDVVLPYISEIDGMVQEKQMGNVKDLT
ECGQAQNEMGEHKLECELVQSDNSKKNKELIAYRTRSKQKK (SEQ ID NO: 159)

>KDO78819.1 hypothetical protein CISIN_1g001119mg [*Citrus sinensis*]
MASPSSGRLAITPSSRVLQSPLSDESIWKRLKEAGLDEVSIKRRDKAALIAYIAKLETEIFEHQHHMGLLILEKKELASK
YEQIKASAEAAELLQKHDRASHLSAIAEARKREESLKKTLGVEKECIASLEKAVHEIRAESAETKVAADSKFAEARCMVE
NAQKKFAEAEAKLHAAESLQAEANRYHRSAERKLQEVVAREDDLSRRIASFKADCEEKEREIIRERQSLSDRKKILQQEH
ERLLDAQTLLNEREDHILSKLQELSRKEKELEASRANVEEKFKALNEEKSNLDLTLVSLLKREEAVIEREASLQKKEQKL
LVSQETLASKESNEIQKIIANHESALRVKQSEFEAELAIKYKLAEDEIEKKRRAWELRDLDLGQREESLLEREHDLEVQS
RALVDKEKDLVERSHLLEEKENKLIAFEKEADLKKSLLQKEKEEVNIIKSDLQKSLSSLDEKKKQVNCAKDKLEAMKSEA
GELSVLEIKLKEELDVVRAQKLELMVETDKLQLEKAKFEAEWEMIDEKREELRKEAERVAVERVVVSKSLKDERDSLRQE
RDAMRDQHKRDVDSLNREREEFMNKMVHEHSEWFTKIQQERADFLLGIEMQKRDLENCIEKRREELESSFREREKAFEEE
KMREFQQISSLKEKAEKELEQVTLEIKRLDLERMEINMDRQRRDREWAELNNSIEELMVQRQKLEEQRQLLHADREEIQA
ESERLKKLEDLKIAVDYMAVSEMQRSRLEHSQKKISAKRHLNQQTSLAHADLGSDQKFDVTNNGDRFNTPSVQKTASASP
PSLARFSWIKRFADLVEKHSGENSVENDEEKSPTSDHEDASLTINSRKRQPVRYSFGEPKVILEVPSENEVVKRTVDLES
ENNQNAAQKCKQSVSEDGIHAARKRRVDVDCVDPSELLMQNNKRRKQQEDFPRNSSEEAINHGAVAEQSNLPEDQHTLTS
KNKSNVPEGLHTLTSNNHTQGDGSQNSVAESVQDIVKVGGTNDHSTPAHTDDVVLPYISEIDGMVQEKQMGNVKDLTECG
QAQNEMGEHKLECELVQSDNSKKNKELIAYRTRSKQKK (SEQ ID NO: 160)

>KDO78824.1 hypothetical protein CISIN_1g001119mg [*Citrus sinensis*]
MGLLILEKKELASKYEQIKASAEAAELLQKHDRASHLSAIAEARKREESLKKTLGVEKECIASLEKAVHEIRAESAETKV
AADSKFAEARCMVENAQKKFAEAEAKLHAAESLQAEANRYHRSAERKLQEVVAREDDLSRRIASFKADCEEKEREIIRER
QSLSDRKKILQQEHERLLDAQTLLNEREDHILSKLQELSRKEKELEASRANVEEKFKALNEEKSNLDLTLVSLLKREEAV
IEREASLQKKEQKLLVSQETLASKESNEIQKIIANHESALRVKQSEFEAELAIKYKLAEDEIEKKRRAWELRDLDLGQRE TABLE 3-continued

| Polypeptide sequence of citrus plant negative immune response regulators |
|---|
| ESLLEREHDLEVQSRALVDKEKDLVERSHLLEEKENKLIAFEKEADLKKSLLQKEKEEVNIIKSDLQKSLSSLDEKKKQVNCAKDKLEAMKSEAGELSVLEIKLKEELDVVRAQKLELMVETDKLQLEKAKFEAEWEMIDEKREELRKEAERVAVERVVVSKSLKDERDSLRQERDAMRDQHKRDVDSLNREREEFMNKMVHEHSEWFTKIQQERADFLLGIEMQKRDLENCIEKRREELESSFREREKAFEEEKMREFQQISSLKEKAEKELEQVTLEIKRLDLERMEINMDRQRRDREWAELNNSIEELMVQRQKLEEQRQLLHADREEIQAESERLKKLEDLKIAVDYMAVSEMQRSRLEHSQKKISAKRHLNQQTSLAHADLGSDQKFDVTNNGDRFNTPSVQKTASASPPSLARFSWIKRFADLVFKHSGENSVENDEEKSPTSDHEDASLTINSRKRQPVRYSFGEPKVILEVPSENEVVKRTVDLESENNQNAAQKCKQSVSEDGIHAARKRRVDVDCVDPSELLMQNNKRRKQQEDFPRNSSEEAINHGAVAEQSNLPEDQHTLTSKNKSNVPEGLHTLTSNNHTQGGNEEASILIVDKIIKISEVTCEMTDADNFINQEKIDGSQNSVAESVQDIVKVGGTNDHSTPAHTDDVVLPYISEIDGMVQEKQMGNVKDLTECGQAQNEMGEHKLECELVQSDNSKKNKELIAYRTRSKQKK (SEQ ID NO: 161) |
| >KDO78823.1 hypothetical protein CISIN_1g001119mg [*Citrus sinensis*] MASPSSGRLAITPSSRVLQSPLSDESIWKRLKEAGLDEVSIKRRDKAALIAYIAKLETEIFEHQHHMGLLILEKKELASKYEQIKASAEAAELLQKHDRASHLSAIAEARKREESLKKTLGVEKECIASLEKAVHEIRAESAETKVAADSKFAEARCMVENAQKKEAEAEAKLHAAESLQAEANRYHRSAERKLQEVVAREDDLSRRIASFKADCEEKEREIIRERQSLSDRKKILQQEHERLLDAQTLLNEREDHILSKLQELSRKEKELEASRANVEEKFKALNEEKSNLDLTLVSLLKREEAVIEREASLQKKEQKLLVSQETLASKESNEIQKIIANHESALRVKQSEFEAELAIKYKLAEDEIEKKRRAWELRDLDLGQREESLLEREHDLEVQSRALVDKEKDLVERSHLLEEKENKLIAFEKEADLKKSLLQKEKEEVNIIKSDLQKSLSSLDEKKKQVNCAKDKLEAMKSEAGELSVLEIKLKEELDVVRAQKLELMVETDKLQLEKAKFEAEWEMIDEKREELRKEAERVAVERVVVSKSLKDERDSLRQERDAMRDQHKRDVDSLNREREEFMNKMVHEHSEWFTKIQQERADFLLGIEMQKRDLENCIEKRREELESSFREREKAFEEEKMREFQQISSLKEKAEKELEQVTLEIKRLDLERMEINMDRQRRDREWAELNNSIEELMVQRQKLEEQROLLHADREEIQAESERLKKLEDLKIAVDYMAVSEMQRSRLEHSQKKISAKRHLNQQTSLAHADLGSDQKFDVINNGDRFNTPSVQKTASASPPSLARFSWIKRFADLVFKHSGENSVENDEEKSPTSDHEDASLTINSRKRQPVRYSFGEPKVILEVPSENEVVKRTVDLESENNQNAAQKCKQSVSEDGIHAARKRRVDVDCVDPSELLMONNKRRKQQEDFPRNSSEEAINHGC (SEQ ID NO: 162) |
| >XP_024035968.1 protein CROWDED NUCLEI 4 isoform X3 [*Citrus clementina*] MASPSSGRLSITPSSRVLQSPLSDESIWKRLKEAGLDEESIKRRDKAALIAYIAKLETEIFEHQHHMGLLILEKKELASKYEQIKASAEAAELLQKHDQASHLSAIAEARKREESLKKTLGVEKECIASLEKAVHEIRAESAETKVAADSKFAEARCMVENAQKKEAEAEAKLHASESLQAEANRYHRSAERKLQDVVAREDDLSRRIASFKADCEEKEREIIRERQSLSDRKKILQQEHERLLDAQTLLNEREDHILSKLQELSRKEKELEASRANVEEKFKALNEEKSNLDLTLVSLLKREEVYTISFPFLFLNLVLICFHVLFTGNYIKYDSSIECTQAVIEREASLOKKEQKLLVSQETLASKESNEIQKIIANHESALRVKQSEFEAELAIKYKLAEDEIEKKRRAWELRDLDLGQREESLLEREHDLEVQSRALVDKEKDLVERSHLLEEKENKLIAFEKEADLKKSLLQKEKEEVNIIKSDLQKSLSSLDEKKKQVNCAKDKLEAMKSEAGELSVLEIKLKEELDVVRAQKLELMVETDKLQLEKAKFEAEWEMIDEKREELRKEAESVAVERVVVSKSLKDERDSLRQERDAMRDQHKRDVDSLNREREEFMNKMVHEHSEWFTKIQQERADFLLGIEMQKRDLENCIEKRREELESSFREREKAFEEEKMRELQQISSLKEKAEKELEQVTLEIKRLDLERMEINMDRQRRDREWAELNNSIEELKVQRQKLEEQROLLHADREEIQAESERLKKLEDLKIAVDYMAVSEMQRSRLEHSQKKISAKRHLNQQTSLAHADLGSDQKFDVTNNGDRFNTPSVQKTASASPPSLARFSWIKRFADLVEKHSGENSIENDEEKSPTSDHEDASLTINSRKRQPVRYSFGEPKVILEVPSENEVVKRTVDLESENNQNAAQKCKQSVSEDGIHAARKRRVDVDCVDPSELLMQNNKRRKQQEDFPRNSSEEAINHGC (SEQ ID NO: 163) |
| >KDO78825.1 hypothetical protein CISIN_1g001119mg [*Citrus sinensis*] MVENAQKKFAEAEAKLHAAESLQAEANRYHRSAERKLQEVVAREDDLSRRIASFKADCEEKEREIIRERQSLSDRKKILQQEHERLLDAQTLLNEREDHILSKLQELSRKEKELEASRANVEEKFKALNEEKSNLDLTLVSLLKREEAVIEREASLQKKEQKLLVSQETLASKESNEIQKIIANHESALRVKQSEFEAELAIKYKLAEDEIEKKRRAWELRDLDLGQREESLLEREHDLEVQSRALVDKEKDLVERSHLLEEKENKLIAFEKEADLKKSLLQKEKEEVNIIKSDLQKSLSSLDEKKKQVNCAKDKLEAMKSEAGELSVLEIKLKEELDVVRAQKLELMVETDKLQLEKAKFEAEWEMIDEKREELRKEAERVAVERVVVSKSLKDERDSLRQERDAMRDQHKRDVDSLNREREEFMNKMVHEHSEWFTKIQQERADELLGIEMQKRDLENCIEKRREELESSFREREKAFEEEKMREFQQISSLKEKAEKELEQVTLEIKRLDLERMEINMDRQRRDREWAELNNSIEELMVQRQKLEEQROLLHADREEIQAESERLKKLEDLKIAVDYMAVSEMQRSRLEHSQKKISAKRHLNQQTSLAHADLGSDQKFDVTNNGDRFNTPSVQKTASASPPSLARFSWIKRFADLVFKHSGENSVENDEEKSPTSDHEDASLTINSRKRQPVRYSFGEPKVILEVPSENEVVKRTVDLESENNQNAAQKCKQSVSEDGIHAARKRRVDVDCVDPSELLMQNNKRRKQQEDFPRNSSEEAINHGAVAEQSNLPEDQHTLTSKNKSNVPEGLHTLTSNNHTQGGNEEASILIVDKIIKISEVTCEMTDADNFINQEKIDGSQNSVAESVQDIVKVGGTNDHSTPAHTDDVVLPYISEIDGMVQEKQMGNVKDLTECGQAQNEMGEHKLECELVQSDNSKKNKELIAYRTRSKQKK (SEQ ID NO: 164) |
| >XP_006466412.1 protein CROWDED NUCLEI 4 isoform X3 [*Citrus sinensis*] MASPSSGRLAITPSSRVLQSPLSDESIWKRLKEAGLDEVSIKRRDKAALIAYIAKLETEIFEHQHHMGLLILEKKELASKYEQIKASAEAAELLQKHDRASHLSAIAEARKREESLKKTLGVEKECIASLEKAVHEIRAESAETKVAADSKFAEARCMVENAQKKFAEAEAKLHAAESLQAEANRYHRSAERKLQEVVAREDDLSRRIASFKADCEEKEREIIRERQSLSDRKKILQQEHERLLDAQTLLNEREDHILSKLQELSRKEKELEASRANVEEKFKALNEEKSNLDLTLVSLLKREEVYMISFPFLFLNLVLICFHVFFTGNYIKYDSSIECTQAVIEREASLQKKEQKLLVSQETLASKESNEIQKIIANHESALRVKQSEFEAELAIKYKLAEDEIEKKRRAWELRDLDLSQREESLLEREHDLEVQSRALVDKEKDLVERSHLLEEKENKLIAFEKEADLKKSLLQKEKEEVNIIKSDLQKSLSSLDEKKKQVNCAKDKLEAMKSEAGELSVLEIKLKEELDVVRAQKLELMVETDKLQLEKAKFEAEWEMIDEKREELRKEAERVAVERVVVSKSLKDERDSLRQERDAMRDQHKRDVDSLNREREEFMNKMVHEHSEWETKIQQERADFLLGIEMQKRDLENCIEKRREELESSFREREKAFEEEKMREFQQISSLKEKAEKELEQVTLEIKRLDLERMEINMDRQRRDREWAELNNSIEELMVQRQKLEEQRQLLHADREEIQAESERLKKLEDLKIAVDYMAVSEMQRSRLEHSQKKISAKRHLNQQTSLAHADFGSDQKFDVTNNGDRFNTPVQKTASASPPSLARFSWIKRFADLVFKHSGENSVENDEEKSPTSDHEDASLTINSRKRQPVRYSFGEPKVILEVPSENEVVKRTVDLESENNQNAAQKCKQSVSEDGIHAARKRRVDVDCVDPSELLMQNNKRRKQQEDFPRDSSEEAINHGC (SEQ ID NO: 165) |
| >SlCRWN_Solyc02g091960.2 sequence match in blast db Tomato Genome protein sequences (ITAG release 2.40) MASPGSGRLALTPVNPTPISGLGRVSKTPLTDEVIWKRLREAGFDEDSIKRRDKAALIAYIAKLETELYDHQYQMGLLILERKEWVSKNEQSKAASESAELLYKREQAARLSDTAEAKKLEANLKKALGIEKECVANIEKALHEMRAECAEAKVASENKLAEAQSMMEDAQKKYTDVEEKLRKAESLEAEASLFHRTAERKLREVESREDDLRRQTLLFKSECEAKEKEIQLERQSLSERQKTLQRSQEELLDGQALLNKREEFIFSRSQELNRHEKDLEDEKSNFENDIKSLNEEKRNLEVKLKSLSAREEGIIRREHELYEKEKELLLLQGKIQSKEIDGSKQVMVNQEATLVTKISSIERCADTLLDRTPSNKRRREDGDFISQLTENGASCPLPPT |

TABLE 3-continued

| Polypeptide sequence of citrus plant negative immune response regulators |
|---|
| PDAPDVENLEVLPNQTHIAAEETTVYIDKIVTVHEVTEIDVRKVTEGSPGTLSGDSGRKVGNNGSLESDQNGKPEGRARR TRATRK (SEQ ID NO: 166) |
| >StCRWN_PGSC0003DMP400037089 sequence match in blast db Potato PGSC DM v3.4 protein sequences MASPGSGRLALTPVNPTPISGLGRVSKTPLTDEVIWKRLREAGFDEDSIKRRDKAALIAYIAKLETELYDHQYQMGLLIL ERKEWVSKNEQFKAASVSAELLYKREQAARLSDMAEAKKLEANLKKALGIEKECVANIEKALHEMRAECAEAKVASENKL TEAQSMMEDAQKKYADVEEKLRKAESLEAEASLFHRTAERKLREVESREDDLRRQTLLFKSDCEAKEKEIQLERQSLSER LKTLQRSQEELLDAQALLNKREEFIFSRSQELNRHEKDLEDEKSNLENDIKSLNEKKRNLEVKLKSLSAREEGIIKREHK LNEKEEELLLLQGKMQSKEIDDSKQVMVNQEATLVTKISSIEAELETKRKLVEDEIQTKRRAWELKDMDIKSREDLITDK EYDLERQSRTLAEKEKELEDKVHVIEEKERNLQAAEKEVELQRTVLQQEREGISKMRNDLEKSLKMLDEKRKCVDHEEEK VEAMKNETQELLILETRLKLEIDMIRAEKEEIEMEADRLKAEKAKFETEWEVIDEKREELQKEAERVAEEKLAISKLLKD SRDSLKAEKNAIQEEYKQNLESLSRDRETFMYEIESERAEWFNKIQKERENFLLDVEMQKKELENRIEKRREEIETDLKE KEKAFEELKKRELQDIASLRETVEKELEHVGLELNKLDAERKEINLDRERRDKEWAELNNAIEELKVQRLKLEKQRELLH ADRKEILAQIEQLKKLEDVKIIPDRIATPKKLHSGLPSNELKPSAKRLLKHASVLGSGLDGNGNNGVRQDTPSIMKENGN SSSTLSTPFSWLKRCADTLLDRTPSNKRRREDGHFISQLTEYGASGTLSSSPDAPDVEHLEVLPNHTPIAAEETTVYIDK IVTVHEVTEIDVRKVTEGSLETLSGESGRKVGNNGSLQSDKNGKPEGRSRRTKATRK (SEQ ID NO: 167) |

| GPX8 protein sequences |
|---|
| >PtGPX8.1_Ptrif.0003s0313.1.v1.3.1_*Poncirus_trifoliata* MTSQFIQNPESIFDLSVKDARGHEVDLSTYKGKVLLIVNVASKCGMTNSN YIELSQLYDKYKDQGLEILAFPCNQFGEEEPGSNDQIADFVCTRFKSEFP IFEKIDVNGEHASPLYKLLKSGKWGIFGDDIQWNFAKFLVDKNGQVVDRY YPTTSPLSLEHDIKKLLGLS- (SEQ ID NO: 168) |
| >PPtGPX8.2_trif.0003s0292.1.v1.3.1_*Poncirus_trifoliata* MLRCYHLKRNLGGIATSLILTRHFTSNYKQTLLRPSKSNPISLVSRPCFF ASRSDHTMASQSKTSVHDFTVKDAKGQDVDLSIYKGKLLLIVNVASQCGL TNSNYTELSQLYDKYKNQGLEILAFPCNQFGAQEPGDNEQIQEFACTRFK AEFPIFDKVDVNGDNAAPLYKHLKSSKGGLFGDSIKWNFSKFLVDKEGNV VERYAPTTSPLSIEKDIKKLLETA- (SEQ ID NO: 169) |
| >XP_006439619.1 probable glutathione peroxidase 8 [*Citrus clementina*] MTSQFIQNPESIFDLSVKDARGHEVDLSTYKGKVLLIVNVASKCGMTNSNYIELSQLYDKYKDQGLEILAFPCNQFGEEE PGSNDQIADFVCTRFKSEFPIFEKIDVNGEHASPLYKLLKLGKWGIFGDDIQWNFAKFLVDKNGEVVDRYYPTTSPLSLE RDIKKLLGLS (SEQ ID NO: 170) |
| >ESR52856.1 hypothetical protein CICLE_v10022566mg [*Citrus clementina*] MTNSNYIELSQLYDKYKDQGLEILAFPCNQFGEEEPGSNDQIADFVCTREKSEFPIFEKIDVNGEHASPLYKLLKLGKWG IFGDDIQWNFAKFLVDKNGEVVDRYYPTTSPLSLERDIKKLLGLS (SEQ ID NO: 171) |
| >GAY39049.1 hypothetical protein CUMW_041400 [*Citrus unshiu*] MTSQFIQNPEMPEAMSGMTNSNYIELSQLYDKYKDQGLEILAFPCNQFGEEEPGSNDQIADFVCTRFKSEFPIFEKIDVN GEHASPLYKLLKSGKWGIFGDDIQWNFAKFLVDKNGEVVDRYYPTTSPLSLERDIKKLLGLS (SEQ ID NO: 172) |
| >GAY39048.1 hypothetical protein CUMW_041400 [*Citrus unshiu*] MTSQFIQNPESIFDLSVKDARGHEVDLSTYKGKVLLIVNVASKCGMTNSNYIELSQLYDKYKDOGLEILAFPCNQFGEEE PGSNDQIADFVCTREKSEFPIFEKIDVNGEHASPLYKLLKSGKWGIFGDDIQWNFAKFLVDKNGEVVDRYYPTTSPLSLE RDIKKLLGLS (SEQ ID NO: 173) |
| >XP_006476628.1 probable glutathione peroxidase 8 isoform X2 [*Citrus sinensis*] MTSQFIQNPESIFDLSVKDARGHEVDLSTYKGKVLLIVNVASKCGMTNSNYIELSQLYDKYKDQGLEILAFPCNQFGEEE PGSNDQIADFVCTRFKSEFPIFEKIDVNGEHASPLYKLLKSGKWGIFGDDIQWNFAKFLVDKNGQVVDRYYPTTSLLSLE HDIKKLLGLS (SEQ ID NO: 174) |
| >XP_006476629.1 probable glutathione peroxidase 8 isoform X1 [*Citrus sinensis*] MFLGVLFIYLIIIIGHSQDARGHEVDLSTYKGKVLLIVNVASKCGMTNSNYIELSQLYDKYKDQGLEILAFPCNQFGEEE PGSNDQIADFVCTREKSEFPIFEKIDVNGEHASPLYKLLKSGKWGIFGDDIQWNFAKFLVDKNGQVVDRYYPTTSLLSLE HDIKKLLGLS (SEQ ID NO: 175) |
| >GAY39050.1 hypothetical protein CUMW_041410 [*Citrus unshiu*] MTSQFIQNPESIFDLSVKDARGHEVDLSTYKGKVLLIVNVASKCGMTNSNYIELSQLYDKYKDQGLEILAFPCNQFGEEE PGSNDQIADFVCTREKSEFPIFEKIDVNGEHASPLYKLLKSGKWGIFGDDIQWNFAKFLVDKNGEVVDRYYPTTSPLSLE LHQILTSQRDIKKLLGLS (SEQ ID NO: 176) |
| >KDO76095.1 hypothetical protein CISIN_1g030881mg [*Citrus sinensis*] MTNSNYIELSQLYDKYKDQGLEILAFPCNQFGEEEPGSNDQIADFVCTRFKSEFPIFEKIDVNGEHASPLYKLLKSGKWG IFGDDIQWNFAKFLVDKNGQVVDRYYPTTSLLSLEHDIKKLLGLS (SEQ ID NO: 177) |
| >KDO76099.1 hypothetical protein CISIN_1g030881mg [*Citrus sinensis*] MTSQFIQNPESIFDLSVKDARGHEVDLSTYKGKVLLIVNVASKCGMTNSNYIELSQLYDKYKDQGLEILAFPCNQFGEEE PGSNDQIADFVCTRFKSEFPIFEKIDVNGEHASPLYKLLKSGKWGIFGDDIQWNFAKFLVDKNGQVVDRYYPTTSLLSLE VIL (SEQ ID NO: 178) |
| >ESR52860.1 hypothetical protein CICLE_v10022566mg [*Citrus clementina*] MTSQFIQNPESIFDLSVKDARGHEVDLSTYKGLEILAFPCNQFGEEEPGSNDQIADFVCTREKSEFPIFEKIDVNGEHAS PLYKLLKLGKWGIFGDDIQWNFAKFLVDKNGEVVDRYYPTTSPLSLERDIKKLLGLS (SEQ ID NO: 179) |

TABLE 3-continued

| Polypeptide sequence of citrus plant negative immune response regulators |
|---|
| >GAY39047.1 hypothetical protein CUMW_041400 [*Citrus unshiu*]<br>MTSQFIQNPESIFDLSVKDARGHEILAFPCNQFGEEEPGSNDQIADFVCTREKSEFPIFEKIDVNGEHASPLYKLLKSGK<br>WGIFGDDIQWNFAKFLVDKNGEVVDRYYPTTSPLSLERDIKKLLGLS (SEQ ID NO: 180) |
| >Q06652.1 RecName: Full = Probable phospholipid hydroperoxide glutathione<br>peroxidase; Short = PHGPx; AltName: Full = Salt-associated protein [*Citrus sinensis*]<br>MASQSKTSVHDFTVKDAKGQDVDLSIYKGKLLLIVNVASQCGLTNSNYTELSQLYDKYKNQGLEILAFPCNQFGAQEPGD<br>NEQIQEFACTRFKAEFPIFDKVDVNGDNAAPLYKHLKSSKGGLFGDSIKWNFSKFLVDKEGNVVERYAPTTSPLSIEKDI<br>KKLLETA (SEQ ID NO: 181) |
| >CAE46896.1 phospholipid hydroperoxide glutathione peroxidase [*Citrus sinensis*]<br>MASQSKTSVHDFSVKDAKGQDVDLSIYKGKLLLIVNVASQCGLTNSNYTELSQLYDKYKNQGLEILAFPCNQFGAQEPGD<br>NEQIQEFACTRFKAEFPIFDKVDVNGDNAAPLYKHLKSSKGGLFGDSIKWNFSKFLVDKEGNVVERYAPTTSPLSIEKDI<br>KKLLETA (SEQ ID NO: 182) |
| >GAY39080.1 hypothetical protein CUMW_041630, partial [*Citrus unshiu*]<br>DAKGQDVDLSIYKGKLLLIVNVASQCGLTNSNYTELSQLYDKYKNQGLEILAFPCNQFGAQEPGDNEQIQEFACTRFKAE<br>FPIFDKVDVNGDNAAPLYKHLKSSKGGLFGDSIKWNFSKFLVDKEGNVVERYAPTTSPLSIEKDIKKLLETA (SEQ ID<br>NO: 183) |
| >XP 006439586.1 probable phospholipid hydroperoxide glutathione peroxidase<br>[*Citrus clementina*]<br>MLRCYLLKRNLGIATSHILTRHFTSNYKQTLLRPSKSNPISLVSRPCFFASRSDHTMASQSKTSVHDFTVKDAKGQDVDL<br>SIYKGKLLLIVNVASQCGLTNSNYTELSQLYDKYKNQGLEILAFPCNQFGAQEPGDNEQIQEFACTREKAEFPIFDKVDV<br>NGDNAAPLYKHLKSSKGGLFGDSIKWNFSKFLVDKEGNVVERYAPTTSPLSIEKDIKKLLETA (SEQ ID NO: 184) |
| >XP 006476598.1 probable phospholipid hydroperoxide glutathione peroxidase<br>[*Citrus sinensis*]<br>MLRCCASRYLLKRNLGIATSLILTRHFTSNCKQTLLRPSKSNPISLVSRPCFFASRSDHTMASQSKTSVHDFSVKDAKGQ<br>DVDLSIYKGKLLLIVNVASQCGLTNSNYTELSQLYDKYKNOGLEILAFPCNQFGAQEPGDNEQIQEFACTREKAEFPIFD<br>KVDVNGDNAAPLYKHLKSSKGGLFGDSIKWNFSKFLVDKEGNVVERYAPTTSPLSIEKDIKKLLETA (SEQ ID NO:<br>185) |
| >ESR52825.1 hypothetical protein CICLE_v10022130mg [*Citrus clementina*]<br>MISPRDSLILAQCRRQFIFYFLFFIFSFIRFIHLPDFERSGLTNSNYTELSQLYDKYKNQGLEILAFPCNQFGAQEPGDN<br>EQIQEFACTREKAEFPIFDKVDVNGDNAAPLYKHLKSSKGGLFGDSIKWNFSKFLVDKEGNVVERYAPTTSPLSIEKDIK<br>KLLETA (SEQ ID NO: 186) |
| >KDO76161.1 hypothetical protein CISIN_1g027134mg [*Citrus sinensis*]<br>MLRCCASRYLLKRNLGIATSLILTRHFTSNCKQTLLRPSKSNPISLVSRPCFFASRSDHTMASQSKTSVHDFSVKDAKGQ<br>DVDLSIYKGKLLLIVNVASQCGLTNSNYTELSQLYDKYKNQGLEILAFPCNQFGAQEPGDNEQIQEFACTRFKAEFPIFD<br>KVDVNGDNAAPLYKHLKSSKGGLFGDSIKWNFSKFLVDKEGNVVERYAPTTSPLSIEVVLECLCC (SEQ ID NO:<br>187) |
| >SlGPX8 Solyc12g056240.1 sequence match in blast db Tomato Genome protein<br>sequences (ITAG release 2.40)<br>MAGQPEKKPQSVYDFSLKDATGNDVDLSIFKGKVLLIVNVASKCGMTNSNYTELNQLYEKYKDQGLEILAFPCNQFGEEE<br>PGTNDQILNFVCTRFKSDFPIFDKIEVNGENASPLYKFLKSGKWGIFGDDIQWNFAKFLVDKNGQVVDRYYPTTSPLTIE<br>RDMKKLLETI (SEQ ID NO: 188) |
| >StGPX8 XP_006360688.1 PREDICTED: probable glutathione peroxidase 8 [*Solanum<br>tuberosum*]<br>MAGQPEKKPQSVYDFTLKDAIGNDVDLSIYKGKVLLIVNVASKCGMTNSNYTELNQLYEKYKDQDLEILA<br>FPCNQFGEEEPGTNDQILDFVCTREKSDFPIFDKIEVNGENASPLYKFLKSGKWGIFGDDIQWNFAKFLV<br>DKNGQVVDRYYPTTSPLTIERDMKKLLEII (SEQ ID NO: 189) |
| LOX2 protein sequences |
| >PtLOX2.1_Ptrif.0002s0213.1.v1.3.1_*Poncirus_trifoliata*<br>MFNPVLVNQTRSIRTILPLSKPFLHGNGNVFRQIQSSPSFKKGPKIRLGS<br>VSSNSVKAMADTAVSNGVTAVVTVRPPINPLTAGGQVIDDVEDLESKSLQ<br>LELVSAKDENKPTISGNAKIKGVVVKDCEVQYEAEFQVPVDFGEIGAILV<br>ANEHALEMYLKDIVLDGLPSGLVTITCESWVQPNTSKDPRIFFTNKSYLP<br>SKTPNGLQKLRYAELVNLRGNGEGERQKADRIYDYDVYNDLGDPDKDEAL<br>KRPVLGGKQHPYPRRCRTGRPHCKTDEASEERVPSKSLINISPYVPRDEE<br>FSAIKETTFVIRTLFGLFRSLIPNLKAEFVDTDGFPNFTEIDKLFREGVK<br>IKDAEFWKSLLPGFVEEIKDIGEFFLKFTSPETFKRDRFFWFRDEEFARE<br>TLAGLNPCSIRLITEWPLKSSLDRKIYGPSESAITTEMIESEIKGCTTVK<br>EALNQKKLFILDYHDLFLPHVEQVRELGDRTLYGSRTVFYLNPDGTLRPL<br>AIELTRPPMDGKPQWKQAFTPSSDSTKSWLWKLAKAHVLAHDSGYHQLIS<br>HWLRTHCSVEPYAIAAHRQLSALHPINRLLKPHFRYTMEINSLARQSLIN<br>AGGVIESTFLPGKYSMLLSSIIYDKOWRFDHQALPQDLISRGMAVKDPSS<br>PHGLKLTIEDYPFAQDGLDLWDIIKQWVTDYVSHYYPDPSLVESDEELQA<br>WWTEIRTVGHGDKQDETWWPVLNSPKDLIDTITNIVWVASGLHAAVNFGQ<br>YEYAAYFPNRPTIARANMPNEDPSDDEWKIFFERPEAALLTTFPNQKQAT<br>AVISVLDVLSAHSPDEDYLGKYMEPAWGEDKIIKGAFEKFQGRLMELKGT<br>INLRNADKNLKNRNGAGSLPYELLMPLADKSGVTGKGVPYSISI- (SEQ ID NO: 190) |

TABLE 3-continued

| Polypeptide sequence of citrus plant negative immune response regulators |
|---|

> PtLOX2.2_Ptrif.0002s0215.1.v1.3.1_*Poncirus_trifoliata*
MLKPQVHQPQSIKPLFPLSKPFLHGNYGYAFRPVPSTSSLIKGSPKLRIG
SVPRNTIKAIATSTEKSVKVKAVVTVKPTVGGFLSNISLERGLDDIGDLF
GKSLLLELVSAELDPKTGLDKSTIQDYARKIGADGDGNMQYESEFEVPSG
FGEIGAILVENEHHKEMYLKDIVLDGLPNGPVNVTCNSWLHSKHDNKQKR
VFFTNKLYLPSQTPDGLKRYRAEELAILRGNGQGERKTYDRIYDYDVYND
LGDPDKKPELARPVLGGKQNPYPRRCRTGRPRCDTDQSSEKREGNFYVPR
DEAFSEVKQVTFSAKTVYSVLHALVPSLETAIVDPDLGEPYFSAIDALFN
EGVNLPPLKQEGFWNTLLPRLVKAIEDTGDNILLFETPETMDRDKFFWFR
DEEFSRQTLAGLNPYSIRLITEWPLKSTLDPEIYGPPESAITTELIEKEI
GGMISVEEAIKQKKLFILDYHDLFLPYVEKVRQLKATTLYGSRTIFFLTP
GGTLRPIAIELTRPPMNGKPQWKQVFLPSWHSTECWLWKLAKAHVLAHDA
GYHQLVSHWLRTHCCTEPYVIATNRQLSVMHPIYRLLDPHFRYTMEINGL
ARQALVNADGIIESSFSPGKYSMEFSSVAYDKQWRFDHEALPKDLISRGL
AVEDPSAPHGLKLTIEDYPFANDGLDLWDAIKQWVTDYVNHYYPDKSLVE
SDEELQAWWTEIRTVGHGDKKDEPWWPVLKTPQDLIEIITTIVWVTSGHH
AAVNFGQYIYGGYFPNRPTTARCNIATEDPTDEQWKFFLEKPENALLNTF
PSQIQATKVMAILDVLSTHSPDEEYLGKEIEPAWREEPVINAAFEKFRGR
LMELEGIIDARNADPKLRNRNGAGMVPYELLKPFSEPGVTGKGVPYSISI (SEQ ID NO: 191)

> PtLOX2.3_Ptrif.0002s0208.1.v1.3.1_*Poncirus_trifoliata*
MLKPQVHQSHQSLKPLVPLSKPFLQGNVHAFRALQSSRSIKNIPKIRIGI
SPSVNIKAITTFTEKSTEVKAFVTIIPSVGGLVSGFVDDVKDMFGKSLLL
ELVSAELDPKTGAEKPTIKGFAHRAGEDKDGHIIYESKFEVPPSFGEVGA
ILVENEHHKEMYLNDIVLDGPRNGPVNITCGSWVQSKHVNKQKRIFFTNK
SYLPSQTPNGLTRLRAEELINLRGDGQGERKTHDRIYDYDVYNDLGVPDF
CSELARPVLGGKEHPYPRRCRTGRPPCETDPASESRTLINYVPRDEAFSE
IKQLQFSAKTLYSVLHGLVPSLETAIIDTDLGFPYFTAIDKLFNEGVNVP
MPETFKEKALWRTILPRLVKGIEDTGKEVLRFETPETMDRDKFFWFRDEE
FGRQTLAGLNPYSIRLVTEWPLRSTSDPEIYGPPESAITKELIEKEIGGI
MTVEEAIKQKKLFILDYHDLLLPYVEKVRELKGTTLYGSRTLFFSYPSGT
LRPLAIELTRPPMDGKPQWKQVFTPSWHSTECWLWRLAKAHVLAHDSGYH
QLVSHWLRTHCCTEPYIIATNRQLSAMHPINRLLQPHFRYTMEINALARE
ALINAGGIIESTFSPGKYSMEISSVAYDKHWRFDHEALPKDLISRGMAVE
DPSASHGIKLTIEDYPFAKDGLDLWDALKQWVTDYVNHYYPNPISVESDE
ELQSWWTEIRTVGHADKKDEPWWPVLKTPEDLIDIITTIVWVASGHHAAV
NFGQYTFGGYFPNRPTVARTKMPIEDPSDEDWKFFLEKPEDVLLQCFPSQ
IQATIVMAILDTLSSHSPDEEYLGKQMEQAWGDDPVIKAAFERESGRLKE
LEGIIDERNANENLKNRTGAGMVPYELMKPFSEPGVTGQGVPYSISI (SEQ ID NO: 192)

>XP_006445968.1 linoleate 13S-lipoxygenase 2-1, chloroplastic [*Citrus clementina*]
MFNPVLVHQTRSIRTILPLSKPFLHGNGNVFRQIQSSPSFKKGPKIRLGSVPSNSVKAMADTAVSNGVTAVVTVRPPINP
LTAGGQVIDDVEDLFSKSLQLELVSAKDENKPTISGNAKIKGVVVKDCEVQYEAEFQVPVDFGEIGAILVVNEHALEMYL
KDIVLDGLPSGLVTITCESWVQPNTSKDPRIFFTNKSYLPSKTPNGLQKLRYAELVNLRGNGEGERQKADRIYDYDVYND
LGDPDEDEELKRPVLGGKQHPYPRRCRTGRPHCKTDEASEERVPSKSLIPISPYVPRDEEFSAIKETTFVIRGLFGQLRS
LIPNLKAEFVDTDGFPNFTEIDKLFREGVKIKDAEFWKSLLPGFVEEIKDIGDFFLRFTSPETFKRDRFFWFRDEEFARE
TLAGLNPCSIRLITEWPLKSSLDPKIYGPSESAITTEMIESEIKGCTTVKEALNQKKLFILDYHDLFLPYVEQVRELGDR
TLYGSRTVFYLNPDGTLRPLAIELTRPPMDGKPQWKQAFTPSSDSTKSWLWKLAKAHVLAHDSGYHQLISHWLRTHCSVE
PYAIAAHRQLSAMHPINRLLKPHFRYTMEINSLARQSLINAGGVIESTFLPGKYSMLLSSIIYDKQWREDHQALPQDLIS
RGMAAKDPSSPHGLKLTIEDYPFAQDGLDLWDIIKQWVTDYVSHYYPDPSLVESDEELQAWWTEIRTVGHGDKQDETWWP
VLNSPKDLIDTITSIVWVASGLHAAVNFGQYEYAAYFPNRPTIARANMPNEDPSDDEWQIFFERPEAALLTTFPNQRQAT
AVISVLDVLSAHSPDEDYLGKYMEPAWGEDKIIKGAFEKFQGRLMELKGIINLRNADKNLKNRHGAGSLPYELLMPLADK
SGVTGKGVPYSISI (SEQ ID NO: 193)

>AHG99489.1 lipoxygenase [*Citrus suavissima*]
MFNPVLVHQTRSIRTILPLSKPFLHGNGNVFRQIQSSPSFKKGPKIRLGSVPSNSVKAMADTAVSNGVTAVVTVRPPINP
LTAGGQVIDDVEDLFSKSLQLELVSAKDENKPTISGNAKIKGVVVKDCEVQYEAEFQVPVDFGEIGAILVVNEHALEMYL
KDIVLDGLPSGLVTITCESWVQPNTSKDPRIFFTNKSYLPSKTPNGLQKLRYAELVNLRGNGEGERQKADRIYDYDVYND
LGDPDEDEELKRPVLGGKQHPYPRRCRTGRPHCKTDEASEERVPSKSLIPISPYVPRDEESRRLKETTFVIKGIVSDSCV
SLNTKLESRICRHRWVSQTSQKIDKLFREGVKIKDAEFWKSLLPGFVEEIKDIGDFFLRFTSPETFKRDRFFWFRDEEFS
RQTLAGLNPYSIRLIAEWPLKSTLDPEIYGPPESAITTELIEKEIGGMISVEEAIKQKKLFILDYHDLFLPYVEKVRQLK
STTLYGSRTIFFLTPAGTLRPIAIELTRPPMNGKPQWKQVFLPSWHSTECWLWKLAKAHVLAHDAGYHQLVSHWLNTHCC
TEPYVIATNRQLSVMHPIYRLLDPHFRYTMEINGLARQALVNADGIIESSFSPGKYSMEFSSVAYDKQWRFDHEALPKDL
ISRGLAVEDPSAPHGLKLTIEDYPFANDGLDLWDAIKQWVTDYVNHYYPDKSLVESDEELQAWWTEIRTVGHGDKKHEPW
WPVLKTPKDLIEIITTIVWVTSGHHAAVNFGQYTYGGYFPNRPTTARCNIATEDPSDEQWKFFLEKPENALLNTFPSQIQ
ATKVMAILDVLSTHSPDEEYLGKEIEPAWREDPVINAAFEKFRGKLMELEGIIDARNADPKLRNRNGAGMVPYELLKPFS
EPGVTGKGVPYSISI (SEQ ID NO: 194)

>BAB84352.1 lipoxygenase [*Citrus jambhiri*]
MFNPVLVHQTRSIRTILPLSKPFLHGNGNVFRQIQSSPSFKKGPKIRLGSVPSNSVKAMADTAVSNGVTAVVTVRPPINP
LTAGGQVIDDVEDLFSKSLQLELVSAKDENKPTISGNAKIKGVVVKDCEVQYEAEFQVPVDFGEIGAILVVNEHALEMYL
KDIVLDGLPSGLVTITCESWVQPNTSKDPRIFFTNKSYLPSKTPNGLQKLRYAELVNLRGNGEGERQKADRIYDYDVYND
LGDPDEDEELKRPVLGGKQHPYPRRCRTGRPHCKTDEASEERVPSKSLIPISPYVPRDEESRRLKETTFVIKGIVSDSCV
SLNTKLESRICRHRWVSQTSQKIDKLFREGVKIKDAEFWKSLLPGFVEEIKDIGDEFLRFTSPETFKRDRFFWFRDEEFS
RQTLAGLNPYSIRLIAEWPLKSTLDPEIYGPPESAITTELIEKEIGGMISVEEAIKQKKLFILDYHDLFLPYVEKVRQLK
STTLYGSRTIFFLTPAGTLRPIAIELTRPPMNGKPQWKQVFLPSWHSTECWLWKLAKAHVLAHDAGYHQLVSHWLNTHCC TABLE 3-continued Polypeptide sequence of citrus plant negative immune response regulators TEPYVIATNRQLSVMHPIYRLLDPHFRYTMEINGLARQALVNADGIIESSFSPGKYSMEFSSVAYDKQWRFDHEALPKDL
ISRGLAVEDPSAPHGLKLTIEDYPFANDGLDLWDAIKQWVTDYVNHYYPDKSLVESDEELQAWWTEIRTVGHGDKKDEPW
WPALKTPQDLIEIITTIVWVTSGHHAAVNFGQYIYGGYFPNRPTTARCNIATEDPSDEQWKFFLEKPENALLNTFPSQIQ
ATKVMAILDVLSTHSPDEEYLGKEIEPAWREDPVINAAFEKERGKLMELEGIIDARNADPKLRNRNGAGMVPYELLKPFS
EPGVTGKGVPYSISI (SEQ ID NO: 195)

>ESR59207.1 hypothetical protein CICLE_v10014207mg [*Citrus clementina*]
MFNPVLVHQTRSIRTILPLSKPFLHGNGNVFRQIQSSPSFKKGPKIRLGSVPSNSVKAMADTAVSNGVTAVVTVRPPINP
LTAGGQVIDDVEDLFSKSLQLELVSAKDENKPTISGNAKIKGVVVKDCEVQYEAEFQVPVDEGEIGAILVVNEHALEMYL
KDIVLDGLPSGLVTITCESWVQPNTSKDPRIFFTNKSYLPSKTPNGLQKLRYAELVNLRGNGEGERQKADRIYDYDVYND
LGDPDEDEELKRPVLGGKQHPYPRRCRTGRPHCKTDEASEERVPSKSLIPISPYVPRDEEFSAIKETTFVIRGLFGQLRS
LIPNLKAEFVDTDGFPNFTEIDKLFREGVKIKDAEFWKSLLPGFVEEIKDIGDFFLRFTSPETFKRDRFFWFRDEEFARE
TLAGLNPCSIRLITEWPLKSSLDPKIYGPSESAITTEMIESEIKGCTTVKEALNQKKLFILDYHDLFLPYVEQVRELGDR
TLYGSRTVFYLNPDGTLRPLAIELTRPPMDGKPQWKQAFTPSSDSTKSWLWKLAKAHVLAHDSGYHQLISHWLRTHCSVE
PYAIAAHRQLSAMHPINRLLKPHFRYTMEINSLARQSLINAGGVIESTFLPGKYSMLLSSIIYDKQWRFDHQALPQDLIS
R (SEQ ID NO: 196)

>XP_006494720.1 linoleate 13S-lipoxygenase 2-1, chloroplastic [*Citrus sinensis*]
MLKPQVHQPQSIKPLFPLSKPFLHGNYGHAFRPVQSTSTLFKGSPKLRIGSVPRNTIKAIATSTEKSIKVKAVVTVKPTV
GGFLSNISLDQGLDDLGDLFGKSLLLELVSAELDPKTGLDKSTIQDYARKIGADGDGNMQYESEFEVPSGFGEIGAILVE
NEHHKEMYLKDIVLDGLPNGPVNVTCNSWLHSKHDNKQKRVFFTNKLYLPSQTPDGLKRYRAEELTILRGNGQGERKTYD
RIYDYDVYNDLGDPDKKPELARPVLGGKQNPYPRRCRTGRPRCDTDQFSEKREGNFYVPRDEAFSEVKQLTFSAKTVYSV
LHALVPSLETAFVDPDLGFPYFSAIDALFNEGVNLPPLKQEGFWNTLLPRLVKAIEDTGDNILLFETPETMDRDKFFWFR
DEEFSRQTLAGLNPYSIRLITEWPLKSTLDPEIYGPPESAITTELIEKEIGGMISVEEAIKQKKLFILDYHDLFLPYVEK
VRQLKSTTLYGSRTIFFLTPAGTLRPIAIELTRPPMNGKPQWKQVFLPSWHSTECWLWKLAKAHVLAHDAGYHQLVSHWL
RTHCCTEPYVIATNRQLSVMHPIYRLLDPHFRYTMEINGLARQALVNADGIIESSFSPGKYSMEFSSVAYDKQWRFDHEA
LPKDLISRGLAVEDPSAPHGLKLTIEDYPFANDGLDLWDAIKQWVTDYVNHYYPDKSLVESDEELQAWWTEIRTVGHGDK
KHEPWWPVLKTPKDLIEIITTIVWVTSGHHAAVNFGQYTYGGYFPNRPTTARCNIATEDPSDEQWKFFLEKPENALLNTF
PSQIQATKVMAILDVLSTHSPDEEYLGKEIEPAWREDPVINAAFEKFRGKLMELEGIIDARNADPKLRNRNGAGMVPYEL
LKPFSEPGVTGKGVPYSISI (SEQ ID NO: 197)

>GAY49879.1 hypothetical protein CUMW_122450 [*Citrus unshiu*]
MLKPQVHQPQSIKPLFPLSKPFLHGNYGHAFRPVQSTSTLFKGSPKLRIGSVPRNTIKAIATSTEKSIKVKAVVTVKPTV
GGFLSNISLDQGLDDLGDLFGKSLLLELVSAELDPKTGLDKSTIQDYARKIGADGDGNMQYESEFEVPSGFGEIGAILVE
NEHHKEMYLKDIVLDGLPNGPVNVTCNSWLHSKHDNKQKRVFFTNKLYLPSQTPDGLKRYRAEELTILRGNGQGERKTYD
RIYDYDVYNDLGDPDKKPELARPVLGGKQNPYPRRCRTGRPRCDTDQFSEKREGNFYVPRDEAFSEVKQLTFSAKTVYSV
LHALVPSLETAFVDPDLGFPYFSAIDALFNEGVNLPPLKQEGFWNTLLPRLVKAIEDTGDNILLFETPETMDRDKFFWFR
DEEFSRQTLAGLNPYSIRLITQEDKKLHEIAQEWPLKSTLDPEIYGPPESAITTELIEKEIGGMISVEEAIKQKKLFILD
YHDLFLPYVEKVRQLKSTTLYGSRTIFFLTPAGTLRPIAIELTRPPMNGKPQWKQVFLPSWHSTECWLWKLAKAHVLAHD
AGYHQLVSHWLRTHCCTEPYVIATNRQLSVMHPIYRLLDPHFRYTMEINGLARQALVNADGIIESSFSPGKYSMEFSSVA
YDKQWRFDHEALPKDLISRGLAVEDPSAPHGLKLTIEDYPFANDGLDLWDAIKQWVTDYVNHYYPDKSLVESDEELQAWW
TEIRTVGHGDKKHEPWWPVLKTPKDLIEIITTIVWVTSGHHAAVNFGQYTYGGYFPNRPTTARCNIATEDPSDEQWKFFL
EKPENALLNTFPSQIQATKVMAILDVLSTHSPDEEYLGKEIEPAWREDPVINAAFEKERGKLMELEGIIDARNADPKLRN
RNGAGMVPYELLKPFSEPGVTGKGVPYSISI (SEQ ID NO: 198)

>XP_006445963.1 linoleate 13S-lipoxygenase 2-1, chloroplastic [*Citrus clementina*]
MLKPQVHQSHQSLKPLVPLSKPFLRGNFHAFRALQSSSSIKNIPKIRIGISPSVNIKAITTFTQKSTQVKAFVTIKPSVG
GLVSGFVDDVKDMFGKSLLLELVSAELDPKTGAEKPTIKGFAHRAGEDKDGHIIYESKFEVPPSFGEVGAILVENEHHKE
MYLNDIVLDGPRNGPVNITCGSWVQSKHVNKQKRIFFTNKSYLPSQTPNGLTRLRAEELLNLRGDGQGERKTHDRIYDYD
VYNDLGVPDFCSELARPVLGGKEHPYPRRCRTGRPPCETDPASESRTLINYVPRDEAFSEIKQLQFSAKTLYSVLHGLVP
SLETAIIDTDLGFPYFTTIDKLFNEGVNVPMPETFKEKALWRTILPRLVKGIEDTGKEVLRFETPETMDRDKFFWFRDEE
FGRQTLAGLNPYSIRLVTEWPLRSTLDPEIYGPPESAITKELIEKEIGGIMTVEEAIKQKKLFILDYHDLLLPYVEKVRE
LKGTTLYGSRTLFFSYPSGTLRPLAIELTRPPMDGKPQWKQVFTPSWHSTECWLWRLAKAHVLAHDSGYHQLVSHWLRTH
CCTEPYIIATNRQLSAMHPINRLLQPHFRYTMEINALAREALVNAGGIIESTFSPGKYSMELSSVAYDKHWREDHEALPK
DLISRGMAVEDPSAPRGIKLTIEDYPFAKDGLDLWDALKQWVTDFVNHYYPNPSSVESDEELRSWWTEIRTVGHADKKDE
PWWPVLKTPEDLIDIITTIAWVASGHHAAVNFGQYTFGGYFPNRPTVARTKMPIEDPSDEDWKLFLEKPEDVLLQCFPSQ
IQATTVMAILDTLSSHSPDEEYLGKQMEQAWGDDPVIKAAFERFSGRLKELEGIIDERNANENLKNRTGAGMVPYELMKP
FSEPGVTGQGVPYSISI (SEQ ID NO: 199)

>XP_006445970.1 linoleate 13S-lipoxygenase 2-1, chloroplastic [*Citrus clementina*]
MLKPQVHQPQSIKPLFPLSNPFLHGNYGHAFLPVPSTSSLFKGSPKLRIGSVPRNTIKAIATSTEKSIKVKAVVTVKPTV
GSFLSNISLDRGLDDLGDLFGKSLLLELVSAELDPKTGLDKSTIQDYARKIGADGDGNMQYESEFEVPSGFGEIGAILVE
NEHHKEMYLKDIVLDGLPNGPVNVTCNSWLHSKHDNKQKRVFFTNKYLPSQTPDGLKRYRAEELTILRGNGQGERKTYDR
IYDYDVYNDLGDPDKKPELARPVLGGKQNPYPRRCRTGRPRCDTDQFSEKREGNFYVPRDEAFSEVKQLTFSAKTVYSVL
HALVPSLETAFVDPDLGFPYFSAIDALFNEGVNLPPLKQEGFWNTLLPRLVKAIEDTGDNILLFETPETMDRDKFFWFRD
EEFSRQTLAGLNPYSIRLITEWPLKSTLDPEIYGPPESAITTELIEKEIGGMISVEEAIKQKKLFILDYHDLFLPYVEKV
RQLKSTTLYGSRTIFFLTPAGTLRPIAIELTRPPMNGKPQWKQVFLPSWHSTECWLWKLAKAHVLAHDAGYHQLVSHWLR
THCCTEPYVIATNRQLSVMHPIYRLLDPHFRYTMEINGLARQALVNADGIIESSFSPGKYSMEFSSVAYDKQWRFDHEAL
PKDLISRGLAVEDPSAPHGLKLTIEDYPFANDGLDLWDAIKQWVTDYVNHYYPDKSLVESDEELQAWWTEIRTVGHGDKK
HEPWWPVLKTPKDLIEIITTIVWVTSGHHAAVNFGQYIYGGYFPNRPTTARCNIATEDPSDEQWKFFLEKPENALLNTFP
SQIQATKVMAILDVLSTHSPDEEYLGKEIEPAWREDPVINAAFEKFRGKLMELEGIIDARNADPKLRNRNGAGMVPYELL
KPFSEPGVTGKGVPYSISI (SEQ ID NO: 200)

>GAY49897.1 hypothetical protein CUMW_122560 [*Citrus unshiu*]
MSYSPSQRSLTCERMLNPQVHHQSQSIRTLCPLPKPFLRGNGQAFRPAQLNPSFKKASKIGVGFSPSNNSIKAIFNLTEK
STKVKAVITVKPIIPDPLALSSLVGALGLELVSAELDPKTGEEKPTIKGLALGVLGKDDDGNIKYKAELKIPASFGDVGA TABLE 3-continued

| Polypeptide sequence of citrus plant negative immune response regulators |
|---|

ILVESDQLTEMYLQDIVLDGLPNGPVNLTCDSWIQPKIVDKQKRIFFTNKSYLPSQTPNGLKRLRAEELNNLQGDGQGER
KRHERIYDYDVYNDLALPEIKELARPVLGGEEHPYPRRCRTGRPKSFADPASESRSVSIYVPRDEAFADIKLGQFSASSL
YSGLHALVPFLEAILIDKDLGFSSLSDIDKVFNEGIELPPELKDQPLWQKILPILFKTVSNTGKEVFRFDTPETVDRDKF
FWIRNEEFGRETLAGLNPYSIKLLSQLPLKSTLDPEIYGPPESAITTELIEQEIGGLMTVNEAIKQKKLFIIDYHDALLP
YVGKLRQIEGSTLYGSRALFFLNPDGTLRPLAIELTRPPLDGKPQWKQVLRTHCCVEPYIIAANRKLSAMHPINRLLKPH
FRYTMEINAKARLILVNAGGLVETTFFPGKYSMEFSSVIYDKQWRFDHEALPKDLISRGMAVEDPNAPHGLKLTIEDYPF
ANDGLDLWDALKQWVTEYVNHYYTDPSLVESDEELQAWWTEIRTVGHADKKDEPWWPVLKTPQDLIEIVTTIAWVASGQH
AAVNFGQYLYGGYFPNRPTMSRTNMPTEDQSEADWKSFLANPEDTLLQCFPSKMQAMQDMVILDTLSTHSPDEEYLGKEM
EPAWGDDPVIKAAFEKFNRKMQELEGIIDDRNSNENLRNRTGAGIVPYELLKPFSGPGATGKGVPMLKPQVHQSHQSLKP
LVPLSKPFLRGNFHAFRALQSSSSIKNIPKIRIGISPSVNIKAITTFTQKSTQVKAFVTIKPSVGGLVSGFVDDVKDMFG
KSLLLELVSAELDPKTGAEKPTIKGFAHRAGEDKDGHIIYESKFEVPPSFGEVGAILVENEHHKEMYLNDIVLDGPRNGP
VNITCGSWVQSKHVNKQKRIFFTNKSYLPSQTPNGLTRLRAEELLNLRGDGQGERKTHDRIYDYDVYNDLGVPDFCSELA
RPVLGGKEHPYPRRCRTGRPPCETDPASESRTLINYVPRDEAFSEIKQLQFSAKTLYSVLHGLVPSLETAIIDTDLGFPY
FTTIDKLFNEGVNVPMPETFKEKALWRTILPRLVKGIEDTGKEVLRFETPETMDRDKFFWFRDEEFGRQTLAGLNPYSIR
LVTEWPLRSTLDPEIYGPPESAITKELIEKEIGGIMTVEEAIKQKKLFILDYHDLLLPYVEKVRELKGTTLYGSRTLFFS
YPSGTLRPLAIELTRPPMDGKPQWKQVFTPSWHSTECWLWRLAKAHVLAHDSGYHQLVKPYIIATNRQLSAMHPINRLLQ
PHFRYTMEINALAREALVNAGGIIESTFSPGKYSMELSSVAYDKHWRFDHEALPKDLISRGMAVEDPSAPRGIKLTIEDY
PFAKDGLDLWDALKQWVTDFVNHYYPNPSSVESDEELRSWWTEIRTVGHADKKDEPWWPVLKTPEDLIDIITTIAWVASG
HHAAVNFGQYTFGGYFPNRPTVARTKMPIEDPSDEDWKLFLEKPEDVLLQCFPSQIQATTVMAILDTLSSHSPDEEYLGK
QMEQAWGDDPVIKAAFERFSGRLKELEGIIDERNANENLKNRTGAGMVPYELMKPFSEPGVTGQGVPYSISI (SEQ ID
NO: 201)

>XP 006445964.1 linoleate 13S-lipoxygenase 2-1, chloroplastic [*Citrus clementina*]
MLNPQVHHQSQSIRTLCPLPKPFLRGNGQAFRPAQLNPSFKKASKIGVGFSPSNNSIKAIFNLTEKSTKVKAVITVKPII
PDPLALSSLVGALGLELVSAELDPKTGEEKPTIKGLALGVLGKDDDGNIKYKAELKIPASFGDVGAILVESDQLTEMYLQ
DIVLDGLPNGPVNLTCDSWIQPKIVDKQKRIFFTNKSYLPSQTPNGLKRLRAEELNNLQGDGQGERKRHERIYDYDVYND
LALPEIKELARPVLGGEEHPYPRRCRTGRPKSFADPASESRSVSIYVPRDEAFADIKLGQFSASSLYSGLHALVPFLEAI
LIDKDLGFSSLSDIDKVFNEGIELPPELKDQPLWQKILPILFKTVSNTGKEVFRFDTPETVDRDKFFWIRNEEFGRETLA
GLNPYSIKLLSQLPLKSTLDPEIYGPPESAITTELIEQEIGGLMTVNEAIKQKKLFIIDYHDALLPYVGKLRQIEGSTLY
GSRALFFLNPDGTLRPLAIELTRPPLDGKPQWKQVFTPSRHSTDSWLWTLAKAHFLVHDTGYHQLISHWLRTHCCVEPYI
IAANRKLSAMHPINRLLKPHFRYTMEINAKARLILVNAGGLVETTFFPGKYSMEFSSVIYDKQWRFDHEALPKDLISRGM
AVEDPNAPHGLKLTIEDYPFANDGLDLWDALKQWVTEYVNHYYTDPSLVESDEELQAWWTEIRTVGHADKKDEPWWPVLK
TPQDLIEIVTTIAWVASGQHAAVNFGQYLYGGYFPNRPTMSRTNMPTEDQSEADWKSFLANPEDTLLQCFPSKMQAMQDM
VILDTLSTHSPDEEYLGKEMEPAWGDDPVIKAAFEKFNRKMQELEGIIDDRNSNENLRNRTGAGIVPYELLKPFSGPGAT
GKGVPYSISI (SEQ ID NO: 202)

>KDO56506.1 hypothetical protein CISIN_1g002644mg [*Citrus sinensis*]
MTANTYFVQINIYSETGAEKPTIKGFAHRAGEDKDGHIIYESKFEVPPSFGEVGAILVENEHHKEMYLNDIVLDGPRNGP
VNITCGSWVQSKHVNKQKRIFFTNKSYLPSQTPNGLTRLRAEELLNLRGDGQGERKTHDRIYDYDVYNDLGVPDFCSELA
RPVLGGKEHPYPRRCRTGRPPCETDPASESRTLINYVPRDEAFSEIKQLQFSAKTLYSVLHGLVPSLETAIIDTDLGFPY
FTTIDKLFNEGVNVPMPETFKEKALWRTILPRLVKGIEDTGKEVLRFETPETMDRDKFFWFRDEEFGRQTLAGLNPYSIR
LVTEWPLRSTLDPEIYGPPESAITKELIEKEIGGIMTVEEAIKQKKLFILDYHDLLLPYVEKVRELKGTTLYGSRTLFFS
YPSGTLRPLAIELTRPPMDGKPQWKQVFTPSWHSTECWLWRLAKAHVLAHDSGYHQLVSHWLRTHCCTEPYIIATNRQLS
AMHPINRLLQPHFRYTMEINALAREALVNAGGIIESTFSPGKYSMELSSVAYDKHWRFDHEALPKDLISRGMAVEDPSAP
RGIKLTIEDYPFAKDGLDLWDALKQWVTDFVNHYYPNPSSVESDEELRSWWTEIRTVGHADKKDEPWWPVLKTPEDLIDI
ITTIAWVASGHHAAVNFGQYTFGGYFPNRPTVARTKMPIEDPSDEDWKLFLEKPEDVLLQCFPSQIQATTVMAILDTLSS
HSPDEEYLGKQMEQAWGDDPVIKAAFERFSGRLKELEGIIDERNANENLKNRTGAGMVPYELMKPFSEPGVTGQGVPYSI
SI (SEQ ID NO: 203)

>KDO64920.1 hypothetical protein CISIN_1g002617mg [*Citrus sinensis*]
MQYESEFEVPSGFGEIGAILVENEHHKEMYLKDIVLDGLPNGPVNVTCNSWLHSKHDNKQKRVFFTNKLYLPSQTPDGLK
RYRAEELTILRGNGQGERKTYDRIYDYDVYNDLGDPDKKPELARPVLGGKQNPYPRRCRTGRPRCDTDQFSEKREGNFYV
PRDEAFSEVKQLTFSAKTVYSVLHALVPSLETAFVDPDLGFPYESAIDALFNEGVNLPPLKQEGFWNTLLPRLVKAIEDT
GDNILLFETPETMDRDKFFWFRDEEFSRQTLAGLNPYSIRLITEWPLKSTLDPEIYGPPESAITTELIEKEIGGMISVEE
AIKQKKLFILDYHDLFLPYVEKVRQLKSTTLYGSRTIFFLTPAGTLRPIAIELTRPPMNGKPQWKQVFLPSWHSTECWLW
KLAKAHVLAHDAGYHQLVSHWLRTHCCTEPYVIATNRQLSVMHPIYRLLDPHFRYTMEINGLARQALVNADGIIESSFSP
GKYSMEFSSVAYDKQWREDHEALPKDLISRGLAVEDPSAPHGLKLTIEDYPFANDGLDLWDAIKQWVTDYVNHYYPDKSL
VESDEELQAWWTEIRTVGHGDKKHEPWWPVLKTPKDLIEIITTIVWVTSGHHAAVNFGQYTYGGYFPNRPTTARCNIATE
DPSDEQWKFFLEKPENALLNTFPSQIQATKVMAILDVLSTHSPDEEYLGKEIEPAWREDPVINAAFEKFRGKLMELEGII
DARNADPKLRNRNGAGMVPYELLKPFSEPGVTGKGVPYSISI (SEQ ID NO: 204)

>XP_006445965.1 linoleate 13S-lipoxygenase 2-1, chloroplastic [*Citrus clementina*]
MLNLQFHNQSQSIRTLSPLPNPFLHGNGPAFRPAQLRPSFKKAPKIGVGESPSINSIKAIFNLTAEKSTKVKAVITVKPI
VSDPLAVEKLIGTLVLELVSAELDPETGKEKPTIKSRAHRSLFTDDDGNLKYKTEFDVPSNEGEVGAILVEADQLTETFL
KDIALDGLRNGPVNIACDSWIQPKIVDKQKRIFFTNKSYLPSQTPNGLTRLRAEELNNLQGDGQGERKIHERIYDYDVYN
DLGMPDSILKSDLVRPVLGGKEHPYPRRCRTGHPKSSKDPASESWSLSVYVPRDEAFSLLKTAQFSATGVYSALHAVIPF
VESILRIGKDKGFPSLEAIDKLFNEGVELPPEIEKLPSWLKILPNFFKSIANTGKDILRFETPETLKRDKLFWLRDEEFG
RETLAGLNPYGISLVADWPLKSTLDPETYGPTESAITKELIEKEIGGSMTVEEAIKQKKLFIIDYHDALLPYVEKVRQIK
DTTLYGSRTVFFLNPDGTLRPLAIELTRPPMDGKPQWKQVFTPSTGNSTESWLWRLAKAHVLAHDSGYHQLISHWLRTHC
CVEPYVIATNRRLSAMHPINRLLKPHFRYTMEINALARKVLINADGIFETNFFPGKYCMEFSSVIYDKHWRFDNEGLPKD
LIRRGIAVEDPKAPHGLKLNIEDYPYANDGLDLWDALKQWVTNYVNHYYPDPSLVESDEELQAWWTEIRTVGHAEKKDEP
WWPVLKTPQDLIEIITTIAWVASGHHAAVNFGQYLYGGYFPNRPTVARTNLPNEDQTKEEWKSFLEKPEAALLRCFPAQF
QALTVMLVIDLLSTHSPDEEYLGKEMEPAWGDDPVIKAAFEEFNLKMQELERIIDDRNSNENLKNRTGAAIVPYELLKPF
SEPGATGKGVPYSISI (SEQ ID NO: 205)

TABLE 3-continued

| Polypeptide sequence of citrus plant negative immune response regulators |
|---|
| >XP_006494272.1 linoleate 13S-lipoxygenase 2-1, chloroplastic [*Citrus sinensis*] MLNLQFHNQSQSIRTLSPLPNPFLHGNGPAFRPAQLRPSFKKAPKIGVGFSPSINSIKAIFNLTAEKSTKVKAVITVKPIVSDPLAVEKLIGTLVLELVSAELDPETGKEKPTIKSRAHRSLFTDDDGNLKYKTEFDVPSNFGEVGAILVEADQLTETFLKDIALDGLRNGPVNIACDSWIQPKIVDKQKRIFFTNKSYLPSQTPNGLARLRAEELNNLQGDGQGERKIHERIYDYDVYNDLGMPDSILKSDLVRPVLGGKEHPYPRRCRTGHPKSSKDPASESWSLSVYVPRDEAFSLLKTAQFSATGVYSALHAVIPFVESILRIGKDKGFPSLEAIDKLFNEGVELPPEIEKLPSWLKILPNFFKSIANTGKDILRFETPETLKRDKLFWLRDEEFGRETLAGLNPYGISLVADWPLKSTLDPETYGPTESAITKELIEKEIGGSMTVEEAIKQKKLFIIDYHDALLPYVEKVRQIKDTTLYGSRTVFFLNPDGTLRPLAIELTRPPMDGKPQWKQVFTPSTGNSTESWLWRLAKAHVLAHDSGYHQLISHWLRTHCCVEPYVIATNRRLSAMHPINRLLKPHFRYTMEINALARKVLINADGIFETNFFPGKYCMEFSSVIYDKHWREDNEGLPKDLIRRGIAVEDPKAPHGLKLNIEDYPYANDGLDLWDALKQWVTNYVNHYYPDPSLVESDEELQAWWTEIRTVGHAEKKDEPWWPVLKTPQDLIEIITTIAWVASGHHAAVNFGQYLYGGYFPNRPTVARTNLPNEDQTKEEWKSFLEKPEAALLRCFPAQFQALTVMLVIDLLSTHSPDEEYLGKEMEPAWGDDPVIKAAFEEFNLKMQELERIIDDRNSNENLKNRTGAAIVPYELLKPFSEPGATGKGVPYSISI (SEQ ID NO: 206) |
| >XP 006445969.1 linoleate 13S-lipoxygenase 2-1, chloroplastic [*Citrus clementina*] MLKPQVHRYSTPTTVLFPFSKPFLHGNCHVERQVQPSPSLKIGSKVRVSCHSKRHNVSSKNIEAIATSTEKSVSVINAVVTVKASWKDDYEDYFLGRTLRLELVSADLDHTTGSEKSTIYAHARKAGKDKHGNELYESTFNVPSDFGEVGAMSVENEHHVEIYLMNIVLDGFSNGDPVNITCNSWIQPKNKNELKRIFFANKSYLPSQTPDGLKRFRIEELYHLRGNGQGVRQPSDRIYDYDVYNDLGNPDKRRPVLGGKKFPYPRRCRTGRPHYESDPLKEKRDKYIYVPRDETFSDVKQEAFDNMKDYKSMCHAALPYIEKFFDGDKKFEYFTEIDELFNEDGFSLPEAEPGFLNSLARFAKTLKEMGEEVFQFDAPEAMLRDKFFWFRDEEFARQTLAGLNPCSIQLITEWPLKSSLDPKIYGPQESAITKDIIEKELGEMISVEEAIEQKKLFMLDYHDLFLPYVEKVRKLEPTTLYGSRTVFFLTPDNTLRPLAIELTRPPMDDKPHWRKVYTPGSWNSTKTWLWRLAKAHVLAHDSGYHQLVSHWLRSHCVVEPYIIATNRQLSVMHPIYRLLHPHLRYTLELNAIGRDILISAGGVIENTFSPGEYCMEMSSVIYDKQWRFDEQALPKDLMKRGMAVEDPNARHGLKLTIDDYPFAKDGLDLWGILKQWVTDYVNHYYPDQSLVESDDELQAWWTEIRTVGHADKKDEPWWPVLKTPQNLIEILTTIIWVASGHHAAVNFGQYTYAAYFPNRPTIARVNMPDEDPTEKIWKTFIEKPEDALLYTFPNQDQAILVIATLDLLSTHSPDEEFLGKDKEPAWGEDPVINAAFEKFSGRLMELEGIIDERNGDSTLANRNGAGVVPYNLLKPYWKDGDKEKGVPYSISI (SEQ ID NO: 207) |
| >XP_006494271.1 linoleate 13S-lipoxygenase 2-1, chloroplastic [*Citrus sinensis*] MLKPQVHRYSTPTTVLFPFSKPFLHGNCHVFRQVQPSPSLKIGSKVRVSCHSKRHNVSSKNIEAIATSTEKSVSVINAVVTVKATWKDDYEDYLFGRTLRLELVSAELDHTTGSEKSTIYAHASKAGKDKHGNELYEATFNVPSDFGEVGAMSVENEHHVEIYLMNIVLDGFSNGDPVNITCNSWIQPKNKNEPKRIFFTNKSYLPSQTPDGLKRFRIEELYHLRGHGQGVRQPSDRIYDYDVYNDLGNPDKRRPVLGGKKFPYPRRCRTGROHYESDPLKEKRDKYIYVPRDETFSDVKQEAFDNMKDYKSMCHAALPYIEKFFDGDKKFEYFTEIDELFNEDGFSLPEAEPGFLNSLARFAKTLKEMGEEVFQFDAPEAMLRDKFFWFRDEEFARQTLAGLNPCSIQLITEWPLKSSLDPKIYGPRLQESEITKDIIEKELGAMISVEEAIEQKKLFMLDYHDLFLPYVEKVRKLEHTTLYGSRTVFFLTPDNTLRPLAIELTRPPMDDKPLWRKVYTPGSWNSTKTWLWRLAKAHVLAHDSGYHQLVSHWLRSHCVVEPYIIATNRQLSVMHPIYRLLHPHLRYTLELNAIGRDILISAGGVIENTFSPGEYCMEMSSVIYDKQWREDEQALPKDLMKRGMAVEDPNARHGLKLTIDDYPFAKDGLDLWGILKQWVTDYVNHYYPDQSLVESDDELQAWWTEIRTVGHADKKDEPWWPVLKTPQNLIEILTTIIWVASGHHAAVNFGQYTYAAYFPNRPTIARVNMPDEDPTEKFWKTFIEKPEDALLYTFPNQDQAILVIATLDLLSTHSPDEEFLGKGKEPAWGEDPVINAAFEKFSGRLMELEGIIDERNGDSTLVNRNGAGVVPYNLLKPYWKDGDKEKGVPYSISI (SEQ ID NO: 208) |
| >ESR59202.1 hypothetical protein CICLE_v10018178mg, partial [*Citrus clementina*] QKKILNQQVHRSRSIKTLIPFSKPFLHGNGRAFLPVHSSPSFQKSLKIRVGFSASNNIKAIAGATAPSVVSVKVKAVVTVKHGSEKPTINVYASVAGVDLFNIRYEAEFEVPSSFGDVGGILVQHENQKEMYLKDVVLDGFLDGPMNITCDSWVQPLAIDAQKRVFFTNKSYLPSQTPNGLTRLRDEELISLRGSGQGERQPYDRIYDYDVVARPVLGGQEHPYPRRCRTGRPHCTTDPESETRSDSNYVPRDEAFSRIKQATFSAKTLYSLLHGLIPAIKAAFGVNKDLGFPYFTAVDTLFNQGIALPPQEQEEFWGRNLPELIQLAKHILKFATMERHQFFWFRDEEFGRQTLAGLNPCAIQLVTKWPLESTLDPAIYGPPESAITTERVEKLMGGDITVAEAIQQKKLFILDYNDLLLPYVEMVRQLEGTTLYGSRTLFFLTSEGTLRPLVIELTRPPMNGQPQWKQAFQPSWQSTESWLWRLAKAHVLAHDSGYHQLVSHWLRTHACTEPYVIATNRHLSAMHPICTLLKPHLRYTMEINTLARESLINAELSSAVYDQLWRFDYEALPKDLIKRGMAVDDPTAPNGLKLTIEDYPYANDGLNLWFALKKWVTDYSDKELQAWWTEIRTVGHADKKDEPWWPALKTSEDLIEIITTIVWVASGHHAAVNFGQYAYAGYVPNRPSIARTNMPTEEPISEKDMKFFLENPQAVLLRSFPTQLQAIQVMAVLDVLSTHSPDEEYLGNQMEPAWGKDPTIFAAFERFSGRIMELEGIIDERNADMKLKNRNGAGVVPYELLKPFSGRGVTEKGVPYSISI (SEQ ID NO: 209) |
| >XP_024949679.1 linoleate 13S-lipoxygenase 2-1, chloroplastic-like [*Citrus sinensis*] MYLKDIVLKSESRNDDHGVKITCNSWLQPKEENTPTRIFFANKSYLPSATPDGLKRLRRQELRHLQGDGRGVRQLSDRIYDYDVYNDLGNPEKDPKLKRPVLGGKEYPYPRRCRTGRPRSELGDENRADDIYVPRDEAFSDIKLAAFDSKKTYSFVSTLPTLIETKFDGDKKFEYFTEIDELFDEDGFSIPPNLNESIWNIIPRWIRKIKETGEQYLQFETPEALHRDKFFWFRDEEFARQTLARLNPCSIQLITELPRDSSITEEIIEKKLEEILLLHRYKHYAIQQKKLFILDYHDLFLPYVEKVRHIEDEDEALKTTLYGSRTIFFLNPDDTLRPVAIELTRPPMDGKPFWRKVYTPSWNSTDSWLWRLAKAHVLAHDAGYHQLVSHWLSTHCVVEPYVIATNRQLSVIHPIYRLLHPHFRYTVEINAFARKDLVNAGGIIESTFSPGKYSMELSSVAYDKQWRFDHEALPKNLISRRMAAEDPCSPHGLKLTIEDYPYAKDGLDLWDILKKWVTDYVNHYYPNQSLVESDEELQAWWTEIRTVGHGDKEDEPWWPVLKTPQDLIETITTIIWVTSGQHAAVNFGQYTYAGYFPNRPAITRLNMPDEDKSNEIWKIFNEKPDNALLHTFPNPTQATKVMLILSLLSCHSPDEEFLGKDMEPAWGEDPEIKVAFEEFRGRLMELEGTINERNGDINLKNRNGAGVVPYNLLKPFWKDGDKEKGVPYSISI (SEQ ID NO: 210) |
| >KDO64921.1 hypothetical protein CISIN_1g002617mg [*Citrus sinensis*] MCVLMHADQFSEKREGNFYVPRDEAFSEVKQLTFSAKTVYSVLHALVPSLETAFVDPDLGFPYFSAIDALFNEGVNLPPLKQEGFWNTLLPRLVKAIEDTGDNILLFETPETMDRDKFFWFRDEEFSRQTLAGLNPYSIRLITEWPLKSTLDPEIYGPPESAITTELIEKEIGGMISVEEAIKQKKLFILDYHDLFLPYVEKVRQLKSTTLYGSRTIFFLTPAGTLRPIAIELTRPPMNGKPQWKQVFLPSWHSTECWLWKLAKAHVLAHDAGYHQLVSHWLRTHCCTEPYVIATNRQLSVMHPIYRLLDPHFRYTMEINGLARQALVNADGIIESSFSPGKYSMEFSSVAYDKQWRFDHEALPKDLISRGLAVEDPSAPHGLKLTIEDYPFANDGLDLWDAIKQWVTDYVNHYYPDKSLVESDEELQAWWTEIRTVGHGDKKHEPWWPVLKTPKDLIEIITTIVWVTSGHHAAVNFGQYTYGGYFPNRPTTARCNIATEDPSDEQWKFFLEKPENALLNTFPSQIQATKVMAILDVLSTHSPDEEYLGKEIEPAWREDPVINAAFEKFRGKLMELEGIIDARNADPKLRNRNGAGMVPYELLKPFSEPGVTGKGVPYSISI (SEQ ID NO: 211) |

TABLE 3-continued

| Polypeptide sequence of citrus plant negative immune response regulators |
| --- |

>KDO56507.1 hypothetical protein CISIN_1g002644mg [*Citrus sinensis*]
MSIFRNQHDDYLSPIITNKKRLITSIKQYFPFSSFDHNVDLSLCTFPIADPASESRTLINYVPRDEAFSEIKQLQFSAKT
LYSVLHGLVPSLETAIIDTDLGFPYFTTIDKLFNEGVNVPMPETFKEKALWRTILPRLVKGIEDTGKEVLRFETPETMDR
DKFFWFRDEEFGRQTLAGLNPYSIRLVTEWPLRSTLDPEIYGPPESAITKELIEKEIGGIMTVEEAIKQKKLFILDYHDL
LLPYVEKVRELKGTTLYGSRTLFFSYPSGTLRPLAIELTRPPMDGKPQWKQVFTPSWHSTECWLWRLAKAHVLAHDSGYH
QLVSHWLRTHCCTEPYIIATNRQLSAMHPINRLLQPHFRYTMEINALAREALVNAGGIIESTFSPGKYSMELSSVAYDKH
WRFDHEALPKDLISRGMAVEDPSAPRGIKLTIEDYPFAKDGLDLWDALKQWVTDFVNHYYPNPSSVESDEELRSWWTEIR
TVGHADKKDEPWWPVLKTPEDLIDIITTIAWVASGHHAAVNFGQYTFGGYFPNRPTVARTKMPIEDPSDEDWKLFLEKPE
DVLLQCFPSQIQATTVMAILDTLSSHSPDEEYLGKQMEQAWGDDPVIKAAFERFSGRLKELEGIIDERNANENLKNRTGA
GMVPYELMKPFSEPGVTGQGVPYSISI (SEQ ID NO: 212)

>GAY49883.1 hypothetical protein CUMW_122450 [*Citrus unshiu*]
MCVLMHADQFSEKREGNFYVPRDEAFSEVKQLTFSAKTVYSVLHALVPSLETAFVDPDLGFPYFSAIDALFNEGVNLPPL
KQEGFWNTLLPRLVKAIEDTGDNILLFETPETMDRDKFFWFRDEEFSRQTLAGLNPYSIRLITQEDKKLHEIAQEWPLKS
TLDPEIYGPPESAITTELIEKEIGGMISVEEAIKQKKLFILDYHDLFLPYVEKVRQLKSTTLYGSRTIFFLTPAGTLRPI
AIELTRPPMNGKPQWKQVFLPSWHSTECWLWKLAKAHVLAHDAGYHQLVSHWLRTHCCTEPYVIATNRQLSVMHPIYRLL
DPHFRYTMEINGLARQALVNADGIIESSFSPGKYSMEFSSVAYDKQWRFDHEALPKDLISRGLAVEDPSAPHGLKLTIED
YPFANDGLDLWDAIKQWVTDYVNHYYPDKSLVESDEELQAWWTEIRTVGHGDKKHEPWWPVLKTPKDLIEIITTIVWVTS
GHHAAVNFGQYTYGGYFPNRPTTARCNIATEDPSDEQWKFFLEKPENALLNTFPSQIQATKVMAILDVLSTHSPDEEYLG
KEIEPAWREDPVINAAFEKFRGKLMELEGIIDARNADPKLRNRNGAGMVPYELLKPFSEPGVTGKGVPYSISI (SEQ
ID NO: 213)

>GAY49899.1 hypothetical protein CUMW_122570 [*Citrus unshiu*]
MYLKDVVLDGELDGPMNITCDSWVQPLAIDAQKRVFFTNKSYLPSQTPNGLTRLRDEELISLRGSGQGERQPYDRIYDYD
VVARPVLGGQEHPYPRRCRTGRPHCTTDPESETRSDSNYVPRDEAFSRIKQATFSAKTLYSLLHGLIPAIKAAFGENKDL
GFPYFTAIDTLFNQGIALPPQEQEEFWGRNLPELIQLAKHILKFATMERHQFFWFRDEEFGRQTLAGLNPCAIQLVTKWP
LESTLDPAIYGPPESAITTERVEKLMGGDITVAEAIEQKKLFILDYNDLLLPYVEKVRQLEGTTLYRSRTLFFLTSEGTL
RPLVIELTRPPMNGQPQWKQAFQPSWQSTESWLWRLAKAHVLAHDSGYHQLVSHWLRTHACTEPYVTATTRHLSAMHPIC
TLLKPHLRYTMETNTLARESLINAELSSAVYDQLWRFDYEALPKDLIKRGMAVDDPTAPNGLKLTIEDYPYANDGLNLWF
ALKKWVTEYSDKELQAWWTEIRTVGHADKKDEPWWPALKTSEDLIEIITTIVWVASGHHAAVNFGQYAYAGYVPNRPSIA
RTNMPTEEPISEKDMKFFLENPQVVLLRSFPTQLQAIQVMAVLDVLSTHSPDEEYLGNQMEPTWGKDPTIFAAFERFSGR
MMELEGIIDERNADMKLKNRNGARVVPYELLKPFSGRGVTEKGVPYSISI (SEQ ID NO: 214)

>GAY49886.1 hypothetical protein CUMW_122470 [*Citrus unshiu*]
MADPLKEKRDKYIYVPRDETFSDVKQEAFDNMKDYKSMCHAALPYIEKFFDGDKKFEYFTEIDELFNEDGFSLPEAEPGF
LNSLARFAKTLKEMGEEVFQFDAPEAMLRDKFFWFRDEEFARQTLAGLNPCSIQLITEWPLKSSLDPKIYGPRLQESEIT
KDIIEKELGAMISVEEAIEQKKLFMLDYHDLFLPYVEKVRKLEHTTLYGSRTVFFLTPDNTLRPLAIELTRPPMDDKPLW
RKVYTPGSWNSTKTWLWRLAKAHVLAHDSGYHQLVSHWLRSHCVVEPYIIATNRQLSVMHPIYRLLHPHLRYTLELNAIG
RDILISAGGVIENTFSPGEYCMEMSSVIYDKQWRFDEQALPKDLMKRGMAVEDPNARHGLKLTIDDYPFAKDGLDLWGIL
KQWVTDYVNHYYPDQSLVESDDELQAWWTEIRTVGHADKKDEPWWPVLKTPQNLIEILTTIIWVASGHHAAVNFGQYTYA
AYFPNRPTIARVNMPDEDPTEKFWKTFIEKPEDALLYTFPNQDQAILVIATLDLLSTHSPDEEFLGKGKEPAWGEDPVIN
AAFEKFSGRLMELEGIIDERNGDSTLVNRNGAGVVPYNLLKPYWKDGDKEKGVPYSISI (SEQ ID NO: 215)

| PI4K ALPHA protein sequences |
| --- |

>Pt PI4K ALPHA_Ptrif.0008s0676.1.v1.3.1_*Poncirus_trifoliata*
MEALFELCDLIAQNPKQFSEKLAWICNRCPQPELLLSGSPRVSRSHLNAV
LAVARFLSKCGDSADSRPKSVILEFIRAIPSSFSRSFWPQAFSTSDSISS
CFTEFLGYVSKSCDDSPDFAAEVAGLTGEVIISAVCCYGAEDSGITRAFL
LASSKNFPPILPSDANKLVTVLLEQLALPIPASPREHIPINSGTSSSQSS
PLSANHLQPSQSNGSESSPGNEGASIVSGSSVSMNGGASIFGGFTMNDGQ
QFRQQVASFEEESVESLEKQEIAFKLITHVLDKVQIDTKPLEQIRFLAKR
QLQSMSAFLKIRKRDWTEQGPLLKARINAKLSVYQSVARLKIKSLASLDM
EGKTSKRLVLETLALLVDAAESCLLSVWRKLRVCEELESSLLAGIAQIAV
IRGGQPLRVLLIRLKPLVLTACAQGDTWGSSKGAMFETVMKTSCEIIESG
WTKDRAPVDTFIMGLATSIRERNDYDEQVEKEKQAVPAVQLNVIRLLADL
TVAVNKSEVVDMILPLFIESLEEGDASTPSLLRLRLLDAVSHMASLGFEK
SYRETVVLMTRSYLSKLSIVGSAESKTMAAEATTERVETLPAGELLIAGG
LRNAKLRSDYRQRLLSLCSDVGLAAESKSGRSGADELGPLLPAVAEICSD
FDPTVDVEPSLLKLERNLWFYIALFGLAPPIQKTQPPVKSVSSTLNSVGS
MGTIPLQAVTGPYMWNTQWSSAVQHIAQGTPPLVVSSVKWLEDELELNAL
HNPGSRRGSGNEKAAGTQRAALSAALGGRVEVAAMSTISGVKATYLLAVA
FLEIIRFSSNGGILNGGTSLTAARSAFSCVFEYLKTPNLMPSVFQCLNAI
VLRAFETAVSWLEERTAETGKEAEIKESTLFAHACFLIKSMSQREEHLRD
TAVNLLTHLRDKFPQVLWHSSCLDSLLFSFDSDASSAVINDPAWVATVRS
LYQRLVREWVLTSLSYAPCTTQGLLQDKLCKANNWQRVQPTTDMVSLLSE
IRIGTCKNDCWPGIRTANIPAVTAAAAAASGATLKPAEALEVLSTGIVSA
TVKCNHAGEIAGMRRLYNSIGGFQSGTMPTGSFGFGGGFQRLISGAFSQQ
PQTEDDSFNEMLLSKFVHLLQQFVNVAEKGGEVDKGQFRETCSQATALLL
SNLDSNSKSNVEGFSQLLRLLCWCPAYISTPDAMETGVFIWTWLVSAAPQ
LGSLVLAELVDAWLWTIDTKRGLFATDVRYSGPAAKLRPHLAPGEPEPQP
EIDPVQQIIAHRLWLGFFIDRFEVVRHNSVEQLLLLGRMLQGTTNFPWKF
SRHPAAAGTFFTLMLLGLKFCSCQSQGYLQNFKSGLQLLEDRIYRASLGW
FAYEPEWYDINCVNFAQSEAQSLSLFLHYLLNERADAVHHDAKGRGHENG
SALVDVNDQFHPIWGQIENYDVGREKRKQLLLMLCQHEADRLDVWAHPII
SKESVSSRPRISSEKLVEYARTAFQVDPRIALSLASRFPANASLKAEVTQ
LVQLHILDIRCIPEALPYFVTPKAVDEDSALLQQLPHWAACSITQALEFL TABLE 3-continued

| Polypeptide sequence of citrus plant negative immune response regulators |
|---|

TPAYKGHPRVMAYILRVLESYPPERVTFFMPQLVQALRYDDERLVEGYLL
RATQRSDIFAHILIWHLQGETFVPESGKEKDANSVKNSSFQTLLPMVRHR
IIDGFNPKARDLFQREFDFFDKVTNISGALYPLPKEERRAGIRRELEKIE
MEGEDLYLPTAPNKLVRGIRVDSGIPLQSAAKVPIMITFNVVDRDGDQSN
VMPQACIFKVGDDCRQDVLALQVISLLRDIFEAVGINLYLFPYGVLPTGP
EKGIIEVVPNTRSRSQMGETTDGGLYEIFQQDFGPVGSTSFEAARENFII
SSAGYAVASLLLQPKDRHNGNLLFDNMGRLVHIDFGFILETSPGRNMRFE
SAHFKLSHEMTQLLDPSGGMKSDTWNQFVSLCIKGYLAARREMDGIINTV
LLMLDSGLPCFSRGDPIGNLRKRFHPEMSDREAAIFMRNVCTDAYNKWTT
AGYDLIQYLQQGIEK- (SEQ ID NO: 216)

>XP_006423217.1 phosphatidylinositol 4-kinase alpha 1 isoform X1 [*Citrus clementina*]
MEALFELCDLIAQNPKQFSEKLAWICNRCPQPELLLSGSPRVSRSHLNAVLAVARFLSKCGDSADSRPKSVILEFIRAIP
SSFNRSFWPQAFSTSDSISSFFTEFLGYVSKSCDDSPDFAAEVAGLTGEVIISAVCCYGAEDSGITRAFLLASSKNFPPI
LPSDANKLVTVLLEQLALPIPASPREHIPINSGTSSSQSSPLSANHLQPSQSNGSESSPGNEGASIVSGSSVSMNGGASI
FGGFTMNDGQQFGQQFRQQVASFEEESVESLEKQEIAFKLITHVLDKVQIDTKLLEQIRFLAKRQLQSMSAFLKIRKRDW
TEQGPLLKARINAKLSVYQSVARLKIKSLASLDMEGKTSKRLVLETLALLVDAAESCLLSVWRKLRVCEELFSSLLAGIA
QIAVIRGGQPLRVLLIRLKPLVLTACAQGDTWGSSKGAMFETVMKTSCEIIESGWTKDRAPVDTFIMGLATSIRERNDYD
EQVEKEKQAVPAVQLNVIRLLADLTVAVNKSEVVDMILPLFIESLEEGDASTPSLLRLRLLDAVSHMASLGFEKSYRETV
VLMTRSYLSKLSIVGSAESKTMAAEATTERVETLPAGFLLIAGGLRNAKLRSDYRHRLLSLCSDVGLAAESKSGRSGADF
LGPLLPAVAEICSDFDPTVDVEPSLLKLFRNLWFYIALFGLAPPIQKTQPPVKSVSSTLNSVGSMGTIPLQAVTGPYMWN
TQWSSAVQHIAQGTPPLVVSSVKWLEDELELNALHNPGSRRGSGNEKAAGTQRAALSAALGGRVEVAAMSTISGVKATYL
LAVAFLEIIRFSSNGGILNGGTSLTAARSAFSCVFEYLKTPNLMPSVFQCLNAIVLRAFETAVSWLEERTAETGKEAEIK
ESTLFAHACFLIKSMSQREEHLRDTAVNLLTQLRDKFPQVLWHSSCLDSLLFSFDSDASSAVINDPAWVATVRSLYQRLV
REWVLTSLSYAPCTTQGLLQDKLCKANNWQRAQPTTDMVSLLSEIRIGTCKNDCWPGIRTANIPAVTAAAAAASGATLKP
AEALEVLSTGIVSATVKCNHAGEIAGMRRLYNSIGGFQSGTMPTGSFGFGGGFQRLISGAFSQQPQTEDDSFNEMLLSKF
VHLLQQFVNVAEKGGEVDKGQFRETCSQATALLLSNLDSNSKSNVEGFSQLLRLLCWCPAYISTPDAMETGVFIWTWLVS
AAPQLGSLVLAELVDAWLWTIDTKRGLFATDVRYSGPAAKLRPHLAPGEPEPQPEIDPVQQIIAHRLWLGFFIDRFEVVR
HNSVEQLLLLGRMLQGTTNFPWKFSRHPAAAGTFFTLMLLGLKFCSCQSQGYLQNFKSGLQLLEDRIYRASLGWFAYEPE
WYDINCVNFAQSEAQSLSLFLHYLLNERADAFQHDAKGRGHENGSALVDVNDQFHPIWGQIENYDVGREKRKQLLLMLCQ
HEADRLDVWAHPIISKESVSSRPRISSEKLVEYARTAFQVDPRIALSLASRFPANASLKAEVTQLVQLHILDIRCIPEAL
PYFVTPKAVDEDSALLQQLPHWAACSITQALEFLTPAYKGHPRVMAYILRVLESYPPERVTFFMPQLVQALRYDDERLVE
GYLLRATQRSDIFAHILIWHLQGETFVPESGKEKDANSVKNGSFQTLLPMVRQRIIDGFNPKALDLFQREFDFFDKVTNI
SGALYPLPKEERRAGIRRELEKIEMAGEDLYLPTAPNKLVRGIRVDSGIPLQSAAKVPIMITFNVVDRDGDQSNVMPQAC
IFKVGDDCRQDVLALQVISLLRDIFEAVGLNLYLFPYGVLPTGPERGIIEVVPNTRSRSQMGEITDGGLYEIFQQDFGPV
GSTSFEAARENFIISSAGYAVASLLLQPKDRHNGNLLFDNIGRLVHIDFGFILETSPGRNMRFESAHFKLSHEMTQLLDP
SGVMKSDTWNQFVSLCIKGYLAARRYMDGIINTVLLMLDSGLPCFSRGDPIGNLRKRFHPEMSDREAAIFMRNVCTDAYN
KWTTAGYDLIQYLQQGIEK (SEQ ID NO: 217)

>KDO46183.1 hypothetical protein CISIN_1g000157mg [*Citrus sinensis*]
MEALFELCDLIAQNPKQFSEKLAWICNRCPQPELLLSGSPRVSRSHLNAVLAVARFLSKCGDSADSRPKSVILEFIRAIP
SSFNRSFWPQAFSTSDSISSFFTEFLGYVSKSCDDSPDFAAEVAGLTGEVIISAVCCYGAEDSGITRAFLLASSKNFPPI
LPSDANKLVTVLLEQLALPIPASPREHIPINSGTSSSQSSPLSANHLQPSQSNGSESSPGNEGASIVSGSSVSMNGGASI
FGGFTMNDGQQFRQQVASFEEESVESLEKQEIAFKLITHVLDKVQIDTKLLEQIRFLAKRQLQSMSAFLKIRKRDWTEQG
PLLKARINAKLSVYQSVARLKIKSLSSLDMEGKTSKRLVLETLALLVDAAESCLLSVWRKLRVCEELFSSLLAGIAQIAV
IRGGQPLRVLLIRLKPLVLTACAQGDTWGSSKGAMFETVMKTSCEIIESGWTKDRAPVDTFIMGLATSIRERNDYDEQVE
KEKQAVPAVQLNVIRLLADLTVAVNKSEVVDMILPLFIESLEEGDASTPSLLRLRLLDAVSHMASLGFEKSYRETVVLMT
RSYLSKLSIVGSAESKTMAAEATTERVETLPAGFLLIAGGLRNAKLRSDYRHRLLSLCSDVGLAAESKSGRSGADFLGPL
LPAVAAICSDFDPTVDVEPSLLKLFRNLWFYIALFGLAPPIQKTQPPVKSVSSTLNSVGSMGTIPLQAVTGPYMWNTQWS
SAVQHIAQGTPPLVVSSVKWLEDELELNALHNPGSRRGSGNEKAAGTQRAALSAALGGRVEVAAMSTISGVKATYLLAVA
FLEIIRFSSNGGILNGGTSLTAARSAFSCVFEYLKTPNLMPSVFQCLNAIVLRAFETAVSWLEERTAETGKEAEIKESTL
FAHACFLIKSMSQREEHLRDTAVNLLTQLRDKFPQVLWHSSCLDSLLFSFDSDASSAVINDPAWVATVRSLYQRLVREWV
LTSLSYAPCTTQGLLQDKLCKANNWQRAQPTTDMVSLLSEIRIGTCKNDCWPGIRTANIPAVTAAAAAASGATLKPAEAL
EVLSTGIVSATVKCNHAGEIAGMRRLYNSIGGFQSGTMPTGSFGFGGGFQRLISGAFSQQPQTEDDSFNEMLLSKFVHLL
QQFVNVAEKGGEVDKGQFRETCSQATALLLSNLDSNSKSNVEGFSQLLRLLCWCPAYISTPDAMETGVFIWTWLVSAAPQ
LGSLVLAELVDAWLWTIDTKRGLFATDVRYSGPAAKLRPHLAPGEPEPQPEIDPVQQIIAHRLWLGFFIDRFEVVRHNSV
EQLLLLGRMLQGTTNFPWKFSRHPAAAGTFFTLMLLGLKFCSCQSQGYLQNFKSGLQLLEDRIYRASLGWFAYEPEWYDI
NCVNFAQSEAQSLSLFLHYLLNERADAFQHDAKGRGHENGSALVDVNDQFHPIWGQIENYDVGREKRKQLLLMLCQHEAD
RLDVWAHPIISKESVSSRPRISSEKLVEYARTAFQVDPRIALSLASRFPANASLKAEVTQLVQLHILDIRCIPEALPYFV
TPKAVDEDSALLQQLPHWAACSITQALEFLTPAYKGHPRVMAYILRVLESYPPERVTFFMPQLVQALRYDDERLVEGYLL
RATQRSDIFAHILIWHLQGETFVPESGKEKDANSVKNGSFQTLLPMVRQRIIDGFNPKALDLFQREFDFFDKVTNISGAL
YPLPKEERRAGIRRELEKIEMAGEDLYLPTAPNKLVRGIRVDSGIPLQSAAKVPIMITFNVVDRDGDQSNVMPQACIFKV
GDDCRQDVLALQVISLLRDIFEAVGLNLYLFPYGVLPTGPEKGIIEVVPNTRSRSQMGETTDGGLYEIFQQDFGPVGSTS
FEAARENFIISSAGYAVASLLLQPKDRHNGNLLFDNIGRLVHIDFGFILETSPGRNMRFESAHFKLSHEMTQLLDPSGVM
KSDTWNQFVSLCIKGYLAARRYMDGIINTVLLMLDSGLPCFSRGDPIGNLRKRFHPEMSDREAAIFMRNVCTDAYNKWTT
AGYDLIQYLQQGIEK (SEQ ID NO: 218)

>GAY65440.1 hypothetical protein CUMW_241100 [*Citrus unshiu*]
MEALFELCDLIAQNPKQFSEKLAWICNRCPQPELLLSGSPRVSRSHLNAVLAVARFLSKCGDSADSRPKSVILEFIRAIP
SSFNRSFWPQAFSTSDSISSFFTEFLGYVSKSCDESPDFAAEVAGLTGEVIISAVCCYGAEDSGITRAFLLASSKNFPPI
LPSDANKLVTVLLEQLALPIPASPREHIPINSGTSSSQSSPLSANHLQPSQSNGSESSPGNEGASIVSGSSVSMNGGASI
FGGFTMNDGQQFRQQVASFEEESVESLEKQEIAFKLITHVLDKVQIDTKLLEQIRFLAKRQLQSMSAFLKIRKRDWTEQG
PLLKARINAKLSVYQSVARLKIKSLASLDMEGKTSKRLVLETLALLVDAAESCLLSVWRKLRVCEELFSSLLAGIAQIAV
IRGGQPLRVLLIRLKPLVLTACAQGDTWGSSKGAMFETVMKTSCEIIESGWTKDRAPVDTFIMGLATSIRERNDYDEQVE
KEKQAVPAVQLNVIRLLADLTVAVNKSEVVDMILPLFIESLEEGDASTPSLLRLRLLDAVSHMASLGFEKSYRETVVLMT
RSYLSKLSIVGSAESKTMAAEATTERVETLPAGFLLIAGGLRNAKLRSDYRHRLLSLCSDVGLAAESKSGRSGADFLGPL
LPAVAAICSDFDPTVDVEPSLLKLFRNLWFYIALFGLAPPIQKTQPPVKSVSSTLNSVGSMGTIPLQAVTGPYMWNTQWS TABLE 3-continued

| Polypeptide sequence of citrus plant negative immune response regulators |
| --- |
| SAVQHIAQGTPPLVVSSVKWLEDELELNALHNPGSRRGSGNEKAAGTQRAALSAALGGRVEVAAMSTISGVKATYLLAVA<br>FLEIIRFSSNGGILNGGTSLTAARSAFSCVFEYLKTPNLMPSVFQCLNAIVLRAFETAVSWLLKCKYCAFYLEACTSGGA<br>LLVLFLHLSLPDRAIDFCGNIALLEERTAETGKEAEIKESTLFAHACFLIKSMSQREEHLRDTAVNLLTQLRDKFPQVLW<br>HSSCLDSLLFSFDSDASSAVINDPAWVATVRSLYQRLVREWVLTSLSYAPCTTQGLLQDKLCKANNWQRAQPTTDMVSLL<br>SEIRIGTCKNDCWPGIRTANIPAVTAAAAAASGATLKPAEALEVLSTGIVSATVKCNHAGEIAGMRRLYNSIGGFQSGTM<br>PTGSFGFGGGFQRLISGAFSQQPQTEDDSFNEMLLSKFVHLLQQFVNVAEKGGEVDKGOFRETCSQATALLLSNLVTIYF<br>SSSFLHILGIENYSLRKCFILIYVRVHVFFFSFLCQDSNSKSNVEGFSQLLRLLCWCPAYISTPDAMETGVFIWTWLVSA<br>APQLGSLVLAELVDAWLWTIDTKRGLFATDVRYSGPAAKLRPHLAPGEPEPQPEIDPVQQIIAHRLWLGFFIDRFEVVRH<br>NSVEQLLLLGRMLQGTTNFPWKFSRHPAAAGTFFTLMLLGLKFCSCQSQGYLQNFKSGLQLLEDRIYRASLGWFAYEPEW<br>YDINCVNFAQSEAQSLSLFLHYLLNERADAFQHDAKGRGHENGSALVDVNDQFHPIWGQIENYDVGREKRKQLLLMLCQH<br>EADRLDVWAHPIISKESVSSRPRISSEKLVEYARTAFQVDPRIALSLASRFPANASLKAEVTQLVQASWSGEMAVALHIL<br>DIRCIPEALPYFVTPKAVDEDSALLQQLPHWAACSITQALEFLTPAYKGHPRVMAYILRVLESYPPERVTFFMPQLVQAL<br>RYDDEVSNRLVEGYLLRATQRSDIFAHILIWHLQGETFVPESGKEKDANSVKNGSFQTLLPMVRQRIIDGFNPKALDLFQ<br>REFDFFDKVTNISGALYPLPKEERRAGIRRELEKIEMVGEDLYLPTAPNKLVRGIRVDSGIPLQSAAKVPIMITFNVVDR<br>DGDQSNVMPQACIFKVGDDCRQDVLALQVISLLRDIFEAVGLNLYLFPYGVLPTGPERGIIEVVPNTRSRSQMGETTDGG<br>LYEIFQQDFGPVGSTSFEAARENFIISSAGYAVASLLLQPKDRHNGNLLFDNIGRLVHIDEGFILETSPGRNMRFESAHF<br>KLSHEMTQLLDPSGVMKSDTWNQFVSLCIKGYLAARRYMDGIINTVLLMLDSGLPCFSRGDPIGNLRKRFHPEMSDREAA<br>IFMRNVCTDAYNKWTTAGYDLIQYLQQGIEK (SEQ ID NO: 219) |
| >XP_024035329.1 phosphatidylinositol 4-kinase alpha 1 isoform X2 [*Citrus clementina*]<br>MEALFELCDLIAQNPKQFSEKLAWICNRCPQPELLLSGSPRVSRSHLNAVLAVARFLSKCGDSADSRPKSVILEFIRAIP<br>SSFNRSFWPQAFSTSDSISSFFTEFLGYVSKSCDDSPDFAAEVAGLTGEVIISAVCCYGAEDSGITRAFLLASSKNFPPI<br>LPSDANKLVTVLLEQLALPIPASPREHIPINSGTSSSQSSPLSANHLQPSQSNGSESSPGNEGASIVSGSSVSMNGGASI<br>FGGFTMNDGQQFGQQFRQQVASFEEESVESLEKQEIAFKLITHVLDKVQIDTKLLEQIRFLAKRQLQSMSAFLKIRKRDW<br>TEQGPLLKARINAKLSVYQSVARLKIKSLASLDMEGKTSKRLVLETLALLVDAAESCLLSVWRKLRVCEELFSSLLAGIA<br>QIAVIRGGQPLRVLLIRLKPLVLTACAQGDTWGSSKGAMFETVMKTSCEIIESGWTKDRAPVDTFIMGLATSIRERNDYD<br>EQVEKEKQAVPAVQLNVIRLLADLTVAVNKSEVVDMILPLFIESLEEGDASTPSLLRLRLLDAVSHMASLGFEKSYRETV<br>VLMTRSYLSKLSIVGSAESKTMAAEATTERVETLPAGFLLIAGGLRNAKLRSDYRHRLLSLCSDVGLAAESKSGRSGADF<br>LGPLLPAVAEICSDFDPTVDVEPSLLKLFRNLWFYIALFGLAPPIQKTQPPVKSVSSTLNSVGSMGTIPLQAVTGPYMWN<br>TQWSSAVQHIAQGTPPLVVSSVKWLEDELELNALHNPGSRRGSGNEKAAGTQRAALSAALGGRVEVAAMSTISGVKATYL<br>LAVAFLEIIRESSNGGILNGGTSLTAARSAFSCVFEYLKTPNLMPSVFQCLNAIVLRAFETAVSWLEERTAETGKEAEIK<br>ESTLFAHACFLIKSMSQREEHLRDTAVNLLTQLRDKFPQVLWHSSCLDSLLFSFDSDASSAVINDPAWVATVRSLYQRLV<br>REWVLTSLSYAPCTTQGLLQDKLCKANNWQRAQPTTDMVSLLSEIRIGTCKNDCWPGIRTANIPAVTAAAAAASGATLKP<br>AEALEVLSTGIVSATVKCNHAGEIAGMRRLYNSIGGFQSGTMPTGSFGFGGGFQRLISGAFSQQPQTEDDSFNEMLLSKF<br>VHLLQQFVNVAEKGGEVDKGOFRETCSQATALLLSNLDSNSKSNVEGFSQLLRLLCWCPAYISTPDAMETGVFIWTWLVS<br>AAPQLGSLVLAELVDAWLWTIDTKRGLFATDVRYSGPAAKLRPHLAPGEPEPQPEIDPVQQIIAHRLWLGFFIDRFEVVR<br>HNSVEQLLLLGRMLQGTTNFPWKFSRHPAAAGTFFTLMLLGLKFCSCQSQGYLQNFKSGLQLLEDRIYRASLGWFAYEPE<br>WYDINCVNFAQSEAQSLSLFLHYLLNERADAFQHDAKGRGHENGSALVDVNDQFHPIWGQIENYDVGREKRKQLLLMLCQ<br>HEADRLDVWAHPIISKESVSSRPRISSEKLVEYARTAFQVDPRIALSLASRFPANASLKAEVTQLVQLHILDIRCIPEAL<br>PYFVTPKAVDEDSALLQQLPHWAACSITQALEFLTPAYKGHPRVMAYILRVLESYPPERVTFFMPQLVQALRYDDELLCR<br>VWTRWPSNDKKYPILGKLKLYKESQKKCWDGQQKYPSTTVKAEQPK (SEQ ID NO: 220) |

TABLE 4

| Polypeptide sequence of citrus plant positive defense regulators |
| --- |
| BRAP2 protein sequences |
| >PtBRAP2 Ptrif. 0001s0545.2. v1. 3.1_*Poncirus_trifoliata* (SEQ ID NO: 221)<br>MFVLRLHSVDDNHPITIEEAGESTVSSTATRSSANPNPKESERRGLVHLF<br>RGTSQSYQQNPNSRSTCIFVVAVPNYLSSDEFVRFCGEHIDHVEELIFIR<br>NDAMEDRYSVLIKLVDQLTADEFYSNINGKRFSPAEAEVCHMLFMLSVEY<br>TELAEIASTPPAGFTELPTCPICLERLDPDTSGILSTICDHSFQCSCTAK<br>WTVLSCQVCRECHQQDERPTCSVCGTVENLWVCLICGFVGCGRYKEGHAV<br>RHWKDTQHWYSLDLRTQQIWDYVGDNYVHRLNQSKADGKLVEMNSPCMSH<br>EAHCGTCECSEDSGISGALENSKVEAIVDEYNRLLATQLETQRQYYESLL<br>AEAKSKRESLIPETVEKAVASKMQDIQNELEICEEAKKAVADVNSKLIKN<br>QEIMRKKEKEIEEREKTSLRLRDATILDLEEQIRDLTVYIEAQKTLENMT<br>DSDGIKGGTVLPVSYQQSSPTNTRRHKKSSRRKN- |
| >ESR64115.1 hypothetical protein CICLE_v10008137mg [*Citrus clementina*] (SEQ ID NO: 222)<br>MFVLRVHSVDDNHPITIEEAGFCTVSSTATRSSANPNPKFSERRGLVHLERGTSQSYQQNPNSRSTCIFVVAVPNYLSSD<br>EFVRFCGSHIDHVEELIFIRNDAMEDRYSVLIKLVDqLTADEFYSNINGKRFSPAEAEVCHMLFMLSVEYTELAEIASTP<br>PAGFTELPTCPICLERLDPDTSGILSTICDHSFQCSCTAKWTVLSCqVCRFCHQQDERPTCSVCGTVENLWVCLICGEVG<br>CGRYKEGHAVRHWKDTQHWYSLDLRTQQIWDYVGDNYVHRLNQSKADGKLVEMNSPCMSHEAHCGTCECSEDSGISGALE<br>NSKVEAIVDEYNRLLATQLETQRQYYESLLAEAKSKRESLIPETVEKAVASKMQDIQNELDICEEAKKAVADVNPLTTHE<br>RSVILFFFWGVGGCYLMLLIETE |

TABLE 4-continued

| Polypeptide sequence of citrus plant positive defense regulators |
|---|
| >KDO80178.1 hypothetical protein CISIN_1g011525mg [*Citrus sinensis*] (SEQ ID NO: 223)<br>MFVLRVHSVDDNHPITIEEAGFCTVSSTATRSRANPNPKESERRGLVHLERGTSQSYQQNPNSRSTCIFVVAVPNYLSSD<br>EFVRECGSHIDHVEELIFIRNDAMEDRYSVLIKLVDQLTADEFYSNINGKRESPAEAEVCHMLEMLSVEYTELAEIASTP<br>PAGFTELPTCPICLERLDPDTSGILSTICDHSFQCSCTAKWTVLSCQVCRFCHQQDERPTCSVCGTVENLWVCLICGFVG<br>CGRYKEGHAVRHWKDTQHWYSLDLRTQQIWDYVGDNYVHRLNQSKADGKLVEMNSPCMSHEAHCGTCECSEDSGISGALE<br>NSKVEAIVDEYNRLLATQLETQRQYYESLLAEAKSKRESLIPETVEKAVASKMQDIQNELDICEEAKKAVADVNPLTTHE<br>RSVILFFFGGVGGCYLMLLIETE |
| >XP_006450876.1 BRCA1-associated protein [*Citrus clementina*] (SEQ ID NO: 224)<br>MFVLRVHSVDDNHPITIEEAGFCTVSSTATRSSANPNPKESERRGLVHLERGTSQSYQQNPNSRSTCIFVVAVPNYLSSD<br>EFVRECGSHIDHVEELIFIRNDAMEDRYSVLIKLVDQLTADEFYSNLNGKRFSPAEAEVCHMLEMLSVEYTELAEIASTP<br>PAGFTELPTCPICLERLDPDTSGILSTICDHSFQCSCTAKWTVLSCQVCRECHQQDERPTCSVCGIVENLWVCLICGFVG<br>CGRYKEGHAVRHWKDTQHWYSLDLRTQQIWDYVGDNYVHRLNQSKADGKLVEMNSPCMSHEAHCGTCECSEDSGISGALE<br>NSKVEAIVDEYNRLLATQLETQRQYYESLLAEAKSKRESLIPETVEKAVASKMQDIQNELDICEEAKKAVADVNSKLIKN<br>QEIMRKKEKEIEEREITSLRLRDATILDLEEQIRDLTVYIEAQKTLINMTDSDGIKGGTVLPVSYQQSSPTNTRRHKKSS<br>RRKN |
| >GAY45486.1 hypothetical protein CUMW_089840 [*Citrus unshiu*] (SEQ ID NO: 225)<br>MFVLRVHSVDDNHPITIEEAGFCTVSSTATRSRANPNPKFSERRGLVHLERGTSQSYQQNPNSRSTCIFVVAVPNYLSSD<br>EFVRFCGSHIDHVEELIFIRNDAMEDRYSVLIKLVDQLTADEFYSNLNGKRFSPAEAEVCHMLEMLSVEYTELAEIASTP<br>PAGFTELPTCPICLERLDPDTSGILSTICDHSFQCSCTAKWTVLSCQVCRECHQQDERPTCSVCGTVENLWVCLICGFVG<br>CGRYKEGHAVRHWKDTQHWYSLDLRTQQIWDYVGDNYVHRLNQSKADGKLVEMNSPCMSHEAHCGTCECSEDSGISGALF<br>NSKVEAIVDEYNRLLATQLETQRQYYESLLAEAKSKRESLIPETVEKAVASKMQDIQNELDICEEAKKAVADVNSKLIKN<br>QEIMRKKFKEIEEREITSLRLRDATILDLEEQIRDLTVYIEAQKTLTNMTDSDGIKGGTVLPVSYQQSSPENTRRHKKSN<br>S |
| >XP_006475890.1 BRCA1-associated protein [*Citrus sinensis*] (SEQ ID NO: 226)<br>MFVLRVHSVDDNHPITIEEAGFCTVSSTATRSRANPNPKFSERRGLVHLFRGTSQSYQQNPNSRSTCIFVVAVPNYLSSD<br>EFVRECGSHIDHVEELIFIRNDAMEDRYSVLIKLVDQLTADEFYSNLNGKRFSPAEAEVCHMLFMLSVEYTELAEIASTP<br>PAGFTELPTCPICLERLDPDTSGILSTICDHSFQCSCTAKWTVLSCQVCRFCHQQDERPTCSVCGTVENLWVCLICGFVG<br>CGRYKEGHAVRHWKDTQHWYSLDLRTQQIWDYVGDNYVHRLNQSKADGKLVEMNSPCMSHEARCGTCECSEDSGISGALE<br>NSKVEAIVDEYNRLLATQLETQRQYYESLLAEAKSKRESLIPETVEKAVASKMQDIQNELDICEEAKKAVADVNSKLIKN<br>QEIMRKKFKEIEEREITSLRLRDATILDLEEQIRDLTVYIEAQKTLTNMTDSDGIKGGTVLPVSYQQSSPTNTRRHKKSS<br>RRKN |
| >GAY45487.1 hypothetical protein CUMW_089840 [*Citrus unshiu*] (SEQ ID NO: 227)<br>MFVLRVHSVDDNHPITIEEAGFCTVSSTATRSRANPNPKESERRGLVHLERGTSQSYQQNPNSRSTCIFVVAVPNYLSSD<br>EFVRECGSHIDHVEELIFISVLIKLVDQLTADEFYSNINGKRFSPARAEVCHMLEMLSVEYTELAEIASTPPAGFTELPT<br>CPICLERLDPDTSGILSTICDHSFQCSCTAKWTVLSCQVCRFCHQQDERPTCSVCGTVENLWVCLICGFVGCGRYKEGHA<br>VRHWKDTQHWYSLDLRTQQIWDYVGDNYVHRLNQSKADGKLVEMNSPCMSHEAHCGTCECSEDSGISGALENSKVEAIVD<br>EYNRLLATQLETQRQYYESLLAEAKSKRESLIPETVEKAVASKMQDIQNELDICEEAKKAVADVNSKLIKNQEIMRKKEK<br>EIEEREITSERLRDATILDLEEQIRDETVYIEAQKTLINMTDSDGIKGGTVLPVSYQQSSPTNTRRAKKSNS |
| >KDO80180.1 hypothetical protein CISIN_1g011525mg [*Citrus sinensis*] (SEQ ID NO: 228)<br>MFVLRVHSVDDNHPITIEEAGFCTVSSTATRSRANPNPKFSERRGLVHLERGTSQSYQQNPNSRSTCIFVVAVPNYLSSD<br>EFVRFCGSHIDHVEELIFIRNDAMEDRYSVLIKLVDQLTADEFYSNLNGKRFSPAEAEVCHMLFMLSVEYTELAEIASTP<br>PAGFTELPTCPICLERLDPDTSGILSTICDHSFQCSCTAKWTVLSCQVCRECHQQDERPTCSVCGTVENIWVCLICGFVG<br>CGRYKEGHAVRHWKDTQHWYSLDLRTQQIWDYVGDNYVHRLNQSKADGKLVEMNSPCMSHEAHCGTCECSEDSGISGALE<br>NSKVEAIVDEYNRLLATQLETQRQVSTSFPDVKTPT |
| >KDO80177.1 hypothetical protein CISIN 1g011525mg [*Citrus sinensis*] (SEQ ID NO: 229)<br>MSSNTVRNDAMEDRYSVLIKLVDQLTADEFYSNINGKRFSPARAEVCHMLEMLSVEYTELAEIASTPPAGFTELPTCPIC<br>LERLDPDTSGILSTICDHSFQCSCTAKWTVLSCQVCRFCHQQDERPTCSVCGTVENLWVCLICGFVGCGRYKEGHAVRHW<br>KDTQHWYSLDLRTQQIWDYVGDNYVHRLNQSKADGKLVEMNSPCMSHEAHCGTCECSEDSGISGALENSKVEAIVDEYNR<br>LLATQLETQRQYYESLLAEAKSKRESLIPETVEKAVASKMQDIQNELDICEEAKKAVADVNSKLIKNQEIMRKKEKEIEE<br>REITSLRLRDATILDLEEQIRDETVYIEAQKTLTNMTDSDGIKGGTVLPVSYQQSSPTNTRRHKKSSRRKN |
| >StBRAP2_PGSC0003DMP400053855 sequence match in blast db Potato PGSC DM v3.4 protein sequences (SEQ ID NO: 230)<br>MFTLQIHTVDSPQPIPTTIATTSSAAHGPKPNSDLTSSSGSLHLSELRGIAHLFRHLPSSTSTTISNPISRTTTVFIVAA<br>PNYLSPDDELLFCGTHLADETHVMFLKNDGIEHSYSVLINIVNQLAADGFYCSENGKRFKPTEVEVCHIYFIQSVVYEES<br>AYITSTPPVGYTELPTCPVCLERLDQDTSGIQSTLCDHSFQCSCVSKWTYLACQVCRLCQQQDEKPACSECGTMKNLCVC<br>LICGFVGCGRYEKKHAIKHWTDAAHHYSLELETQQIWDYVGDKYVHRLNQSKGDSKLVTVNSRCTATEGECTTCGDDEDS<br>SFSGALFSSKVDSIVDEYNNLLASQLETQRQHYESLLAEAKSGKESSISRAVEKAVESKINDLQAKIEMYTEETKSIVER<br>NQVLLKNQELLQTKYRETAERERLLLKSKDENKLDLKEQIRDLKVYVEAQRKLSNMGISDGKGGTVLSVEPNKQSSSNSR<br>RRGKLGRRRN |

TABLE 4-continued

| Polypeptide sequence of citrus plant positive defense regulators |
|---|
| CYP93 protein sequences |

>PtCYP93_Ptrif.0003s2312.1.v1.3.1_*Poncirus_trifoliata*
(SEQ ID NO: 231)
MSIRIGSVLGVVTSSPDVTKELLKTNDVTFAARKSSAAIECLTYNSSFAF
APNGPYWQFMKKLTAVELLGSRTLCQFLPIRTNELRELIRFLFEKSKSGQ
SVNITDELLKFANNIISQMMLSIRCSSKGGQAEECRTLAREVTEIFGEVN
ISDIIWIEKSFDIQGFHRREKDIHRRYDSLLENIITNREKLRKEKKESEE
KVKDLLDILLDVLENPNSEIKLTRDHIKALCLDELTAGTDTSSTTLEWSL
AELINHPMVLQKAQQEIDQVVGRNRLVQESDVPHLPYIQAIIKESFRIHP
PIPLISRKAVETVKLATT- >XP_006441830.1 licodione synthase [*Citrus clementina*]
(SEQ ID NO: 232)
MTLQPLIFYASLFILSALVLKAIKHSRRLPPSPWALPIVGHLHLLGPSLHHSFHKLSTRYGPLMSIRIGSVLGVVTSSPD
VTKELLKINDVTFAARNSSAAIECLTYNSSFAFAPNGPYWQFMKKLTTVELLGSRTLLQFLPIRTNELHELIRFLFEKSK
SGGSVNITDELLKFTNNIISQMMLSIRCSGKGGQAEECRTLAREVTEIFGEFNISDVIWVEKSEDIQGFRRRFKDIHRRF
DSLLENIITNREKLRKEKKESEEKVKDLLDILLDVLENQNSEIKLTRDHIKALFLDELTAGTDTSSMTVEWALAELINHP
MVLQKAQQEIDQVVGRNRLVQESDVPHLPYIQVIIKESFRIHPPIPLLNRRALEDCKIGNYIIPKGTLLFVNLWSMGRDP
ETWKNPLEFQPERFLSESNSEIDVRGLHYRLLPFGTGRRGCPGLSLAMQELPTTLAAMIQCENFKVTSPDGVVDMSERPG
LSSPRAQDLVCVPVARCAPSIVN >KDO41683.1 hypothetical protein CISIN_1g010779mg [*Citrus sinensis*]
(SEQ ID NO: 233)
MTLQPLIFYASLFILSALVLKAIKHSRRLPPSPWALPIVGHLHLLGPSLHHSFHKLSTRYGPLMSIRIGSVLGVVTSSPD
VTKELLKINDVTFAARNSSAAIECLTYNSSFAFAPNGPYWQFMKKLTTVELLGSRTLLQFLPIRTNELHELIRFLFEKSK
SGGSVNITDELLKFTNNIISQMMLSIRCSGKGGQAEECRTLAREVTEIFGEFNISDIIWIFKSFDIQGFRRRFKDIHRRF
DSLLENIITNREKLRKEKKESEEKVKDLLDILLDVLENQNSEIKLTRDHIKALFLDFLTAGTDTSSMTVEWALAELINHP
MVLQKAQQEIDQVEGRNRLVQLKNHLPYIQAIIKESFRIHPPIPLISRKAVEDCKIGNYVIPKDTVLFVNLWSMGRDPKI
WKNPLEFQPERFLSQSNSEIDVKGLHYQFLPFGTGRRGCPGLSLAMQELPTTLAAMIQCFNFKVTSPDGVVDMSERPGLS
SPRAQDLVCVPVARCAPSILN >XP_024953859.1 licodione synthase-like [*Citrus sinensis*]
(SEQ ID NO: 234)
MLSAHLNGSAQEPYRSFLAMTLQPLIFYASLFILSALVLKAIKHSRRLPPSPWALPIVGHLALLGPSLHASFHKLSTRYG
PIMSIRIGSVLGVVTSSPDVTKELLKINDVTFAARNSSAAIECLTYNSSFAFAPNGPYWQFMKKLTTVELLGSRTLLQFL
PIRINELHELIRFLFEKSKSGGSVSITDELLKFTNNIISQMMLSIRCSGKGGQAEECRTLAREVTEIFGEFNISDIIWIE
KSFDIQGFRRRFKDIHRREDSLLENIITNREKLRKEKKESEEKVKDLLDILLDVLENQNSEIKLTRDHIKALFLDELTAG
TDTSSMTVEWALAELINHPMVLQKAQQEIDQVVGRNRLVQESDFPRLPYIQAIIKESFRIHPPIPLISRKAVEDCKIGNY
VIPKDTVLFVNLWSMGRDPKIWKNPLEFQPERFLSQSNSEIDVRGLHYQLLPFGTGRRGCPGLSLAMQELPATLAAMIQC
FNFKVTSPDGVVDMSERPQLSSPRARDLMCVPVARCPLTSLLLSVQDELTAGTDTSSMTVEWALAELINHPMVLQKAQQE
IDQVVGRNRLVQESDFPRLPYIQAIIKESFRIHPPIPLLNRRALEDCKIGNYIIPKGTLLFVNLWSMGRDPKIWKNPLEF
QPERFFSQSNSEIDVRGLHYQLLPFGTGRRGCPGLSLAMQELPTALASMIQCFDFKVTSPDGVVDMSERPGLSSPRAQDL
VCVPVARCAPSIVNSDVR >XP_006478300.1 licodione synthase-like [*Citrus sinensis*]
(SEQ ID NO: 235)
MTLQPLIFYASLFVLSALVLKAIKHSRRLPPSPWALPIVGHLHELGPSLHHSFHKLSTRYGPLMSVRIGSVLGVVTSCPD
VTKELLKINDVTFTGRKSSAAIECLTYNSSFAFAPYGPYWQFMKKLSAVELLGSRTLHQFLPVRTNELRELIRFLFEKSK
SGQSVNITDELLRFANNIISQMMLSIRCSGKGGQAEECRTLAREVTEIEGEFNISDIIWIFKSEDIQGENRRFKDIHRRY
DSQLENIITNREKLRKEKKESEEKVKDLLDILLDVLENQNSEIKLTRDHVKALCVDFLTAGTDTSSTSLEWSLAELINHP
MVLQEAQQELDQVVGRNRLVQESDVPHLPYIQAIIKESFRIHPPIPLISRKAVEDCKIGNYVIPKDTVLEVNLWSMGRDP
KIWKNPLEFQPERFLSQSNSEIDVKGLHYQFLPFGTGRRGCPGLSLAMQELPATLAAMIQCENFKVTSPDGVVDMSERPG
LSSPRAQDLVCVPVARCAPSILN >GAY62273.1 hypothetical protein CUMW_216480 [*Citrus unshiu*]
(SEQ ID NO: 236)
MTLQPLIFYASLFILSALVEKAIKHSRRLPPSPWALPIVGHLHLLGPSLHHSFHKLSTRYGPLMSVRIGSVLGVVTSCPD
VTKELLKINDVTFTGRKSSAAIECLTYNSSFAFAPYGPYWREMKKLSAVELLGSRTLHQFLPVRTNELRELIRFLFEKSK
SGQSVNITDELLRFANNIISQMMLSIRCSGKGGQAEECRTLAREVTEIFGEFNISDIIWIEKSFDIQGFNRRFKDIHRRY
DSQLENIITNREKLRKEKKESEEKVKDLLDILLDVLENQNSEIKLTRDHVKALCVDELTAGTDTSSTSLEWSLAELINHP
MVLQEAQQELDQVVGRNRLVQESDVPHLPYIQAIIKESFRIHPPIPLISRKAVEDCKIGNYVIPKDTVLFVNLWSMGRDP
KIWKNPLEFQPERFLSQSNSEIDVKGLHYQFLPFGTGRRGCPGLSLAMQELPATLAAMIQCENFKVTSPDGVVDMSERPG
LASPRAQDEVCVPVARCAPSILN >XP_006441833.1 licodione synthase [*Citrus clementina*]
(SEQ ID NO: 237)
MTLQPLIFYASLFILSALVLKAIKHSRRLPPSPWALPIVGHLHLLGPSLHHSFHKLSTRYGPLMSVRIGSVLGVVTSCPD
VTKELLKINDVTFTGRKSSAAIECLTYNSSFAFAPYGPYWRFMKKLSAVELLGSRTLHQFLPVRTNELRELIRFLFEKSK
SGQSVNITDELLRFANNIISQMMLSIRCSGKGGQAEECRTLAREVTEIFGEFNISDIIWIFKSEDIQGENRRFKDIHRRY
DSQLENIITNREKLRKEKKESEEKVKDLLDILLDVLENQNSEIKLTRDHVKALCVDELTAGTDTSSTSLEWSLAELINHP
MVLQEAQQELDQVVGRNRLVQESDVPHLPYIQAIIKESFRIHPPIPLISRKAVEDCKIGNYVIPKDTVLFVNLWSMGRDP
KIWKNPLEFQPERFLSQSNSEIDVKGLHYQFLPFGTGRRGCPGLSLAMQELPATLAAMIQCENFKVTSPDGVVDMTERPG
LASPRAQDLVCVPVARCAPSILN TABLE 4-continued

| Polypeptide sequence of citrus plant positive defense regulators |
|---|
| >ESR55072.1 hypothetical protein CICLE_v10023526mg, partial [*Citrus clementina*] (SEQ ID NO: 238)<br>SLFLLSALVLKAIKNSGRLPPSPWALLIVGHLHLLGPSLHHSFHKLSTCYGPLMSICIGSVLGVVTSSPDVTKERLKIND<br>VTFAARNSSAAIECLTYNSSFAFAPNGPYWLFMKKLTTVELLGSRTLRQFLPIRINKLHELIRFLFEKSKSGESVNIRDE<br>LLKFTNNIISPMMLSIRCSGKGGQAEECRTLAREVAEIFGEFKSEDIQGFHRRFKDIHRREDSLLENVITNREKLRKEKK<br>ESEEKVKGLLDILLDCSGESEFGDQVSVHLFRNIPFLYFGFPHSWHRYFIHDVQWALAELINHPMVLQKAQQEIDQVVGR<br>NGPVQESYVPHLPYIQAIIKESFRIHPPIPLLNRRALEDCKIGNYISPKGTLLFVNLWSMGRVLDHKLDPR |
| NDR1-like protein sequences |
| >PtNDR1-like Ptrif.0006s1395.1.v1.3.1_*Poncirus_trifoliata* (SEQ ID NO: 239)<br>MSEKICDKHGCRRRKIFRTIIAGILIFVVIVLITILIVWAILRPTKPRFI<br>LQDATVYVFNVSNPNVLTSSFQVTISSRNPNDRIGIYYDRLDLYATYHSQ<br>QITYKTSLPTTYQGHKEINVWSPYVYGNAVPVAPYNAVSLTQDQSGGIIP<br>LMFKIDGRVRWKVGTFITGKYHLYVRCSAYINFGNKQAGNAVQNNAVCNN<br>AVKYQLVQSCSVSV- |
| >XP_006430080.1 NDR1/HIN1-like protein 1 [*Citrus clementina*] (SEQ ID NO: 240)<br>MSEKVCDKHGCKRRKIERRIIAGILIFILIVLITILIVWAILRPTKPRFILQDATVYVENVSNPNVLTSSFQVTISSRNP<br>NDRIGIYYDKLDLYATYHNQQITYKTSLPTTYQGHKEINVWSPYVYGNAVPVAPYNAVSLTQDQSSGIIPLMFKIDGRVR<br>WKVGTFITGKYHLYVRCSAYINFGDRQAGTAVGNNAVKYQLVQSCSVSV |
| >KDO70596.1 hypothetical protein CISIN_1g028399mg [*Citrus sinensis*] (SEQ ID NO: 241)<br>MSEKVCDKHGCKRRKIERRIIAGILIFILIVLITILIVWAILRPTKPRFILQDATVYVENVSNPNVLTSSFQVTISSRNP<br>NDRIGIYYDKLDLYATYHSQQITYKTSLPTTYQGHKEINVWSPYVYGNAVPVAPYNAVSLTQDQSSGIIPLMFKIDGRVR<br>WKVGTFITGKYHLYVRCPAYINFGDRQAGTAVGNNAVKYQLVQSCSVSV |
| >XP_006481585.1 NDR1/HIN1-like protein 1 [*Citrus sinensis*] (SEQ ID NO: 242)<br>MSEKVCDKHGCKRRKIFRRIIAGILIFILIVLITILIVWAILRPTKPRFILQDATVYVENVSNPNVLTSSFQVTISSRNP<br>NDRIGIYYDKLDLYATYHSQQITYKTSLPTTYQGHKEVNVWSPYVYGNAVPVAPYNAVSLTQDQSSGIIPLTFKIDGRVR<br>WKVGTFITGKYHLYVRCPAYINFGDRQAGTAVGNNAVKYQLVQSCSVSV |
| >GAY31912.1 hypothetical protein CUMW_280830 [*Citrus unshiu*] (SEQ ID NO: 243)<br>MSEKDCGHSHDDRKKLVRLILNAVGGLIIVVLLIIFLEWAITRPSKPSFILQDATLYAENLSTGPSPPNALTINLQVTIT<br>TRNPNDKIGIYYQKADVYASYRNQQISLATLLPATYQGHKDVIVWSPFLYGNSVPVSPFVAESLGQDLNAGMVMVNIKVD<br>GRIKWKVGTWISGRYHLHVNCPAYITFGDKSKGIASGASLKFQLVQSCSVDV |
| >XP_006424128.1 NDR1/HIN1-like protein 1 [*Citrus clementina*] (SEQ ID NO: 244)<br>MSEKDCGHSHDDKKKLVRLILYAVGGLIIVVLLIIFLFWAITRPSKPSFILQDATLYAFNLSTGPSPPNALTTNLQVTIT<br>TRNPNDKIGIYYQKADVYASYRNQQISLATLLPATYQGHKDVIVWSPFLYGNSVPVSPFVAEALGQDLNAGMVMVNIKVD<br>GRIKWKVGTWISGRYHLHVNCPAYITFGDKSKGIASGASVKFQLVQSCSVDV |
| >XP_006481531.1 NDR1/HIN1-like protein 1 [*Citrus sinensis*] (SEQ ID NO: 245)<br>MSEKDCGHSHDDRKKLVRLILYAVGGLIIVVLLIIFLFWAITRPSKPSFILQDATLYAFNLSTGPSPPNALTTNLQVTIT<br>TRNPNDQIGIYYQKADVYASYRNQQISLATLLPATYQGHKDVIVWSPFLCGNSVPVSPFVAEALGQDLNAGMVMVNIKVD<br>GRIKWKVGTWISGRYHLHVNCPAYITFGDKSKGIASGASLKFQLVQSCSVDV |
| >GAY32947.1 hypothetical protein CUMW_004890 [*Citrus unshiu*] (SEQ ID NO: 246)<br>MTESLDLYATYHSQQITYKTSLPTTYQGHKEVNVWSPYVYGNAVPVAPYNAVSLTQDQSSGIIPLTFKIDGRVRWKVGTE<br>ITGKYHLYVRCPAYINFGDRQAGTAVGNNAVKYQLVQSCSVSV |
| >StNDR1-like PGSC0003DMP400048906 sequence match in blast db Potato PGSC DM v3.4 protein sequences (SEQ ID NO: 247)<br>MSVKECTHHKDKKRKLVRRLFAGILIFLFVVLLTVLLVWAILQPKKPRFILQDATIFNENVSAPNIFSTSIQITIYSRNP<br>NDKIGVYYDKMKTYANYHKQQITYYTQIPSVYQGHKDVNIWSPFVFSNNVPISPINGPDLKEDQQNGGVWLDFKIDGRVK<br>WRVGTITTGHYHLHVTCTAYVPFGNHPGDGGLFVGNNAVKYQLARSCDVSV |
| PSL4 protein sequence |
| >PtPSL4.1_Ptrif.0002s0022.1.v1.3.1_*Poncirus_trifoliata* (SEQ ID NO: 248)<br>MRVVLVDERFTYAIVLSLLWVSSSVIGRSNAASSLLNDPFYGISPQDENY<br>YKTSSNTIKCKDGSKKFAKTQLNDDYCDCPDGTDEPGTSACPNGKFYCQN<br>AGHSPLMIFSSKVNDGICDCCDGSDEYDGKVKCPNTCWEAGKVARDKLKK<br>KIATYQEGVLLRKKEIEQAKQNLVKDEAELSNLKNEEKILKGLVQQLKER<br>KEQIEKAEEKERLQREKEEKERKEAEENERKEKSESGEKDMQEKNKAEEN<br>AYSDDKPDDVRHDDKVGVLEEESFDQGKAGNVDEEPATEAKQIGTSQNLG<br>TPVNGVEQHATEEMEQSASSRSKDGSSTVPETSSDAENQMPPEAEKKEEK |

TABLE 4-continued

| Polypeptide sequence of citrus plant positive defense regulators |
|---|
| NLENGVSENTEELSREELGRLVASRWTGEKTEKQSGEGGAIENDDQGEDV<br>PEYNHDDEEDRYATDTDDDSERYDTEKYDDNDVEDDIDETYREEDHDYTS<br>TSYKTDVDDDLDMSEMTTPSSPSWLEKVQQTVRNILQAVNLFQTPVDKSD<br>AARVRKEYDESSDKLSKIQSRISSLTQKLKHDFGPEKEFYSFHGHCFESK<br>QNKYVYKVCPYKKATQEEGHSTTRLGSWDKFEDSYHIMLESNGDKCWNGP<br>DRSMKVRLRCGLKNEVTDVDEPSRCEYVALLSTPAVCSEEKLQELEHKLD<br>ELNKKQPQHHDEL- |
| >PtPSL4.2_Ptrif.0002s0016.1.v1.3.1_*Poncirus_trifoliata*<br>(SEQ ID NO: 249)<br>MPEWKILLSECRTEPLMIFSSKVNDGICDCCDGSDEYDGKVKCPNTCWEA<br>GKVARDKLKKKIATYQEGVLLRKKEIEQAKQNLVKDEAELSNLKNEEKIL<br>KGLVQQLKERKEQIEKAEEKERLQREKEEKERKEAEENERKEKSESGEKD<br>MQEKNKAEENAYSDDKPDDVRHDDKVGVLEEESFDQGKAGNVDEEPATEA<br>KQIGTSQNLGTPVNGVEQHATEEMEQSASSRSKDGSSTVPETSSDAENQM<br>PPEAEKKEEKNLENGVSENTEELSREELGRLVASRWTGEKTEKQSGEGGA<br>IENDDQGEDVPEYNHDDEEDRYATDTDDDSERYDTEKYDDNDVEDDIDET<br>YREEDHDYTSTSYKTDVDDDLDMSEMTTPSSPSWLEKVQQTVRNILQAVN<br>LFQTPVDKSDAARVRKEYDESSDKLSKIQSRISSLTQKLKHDFGPEKEFY<br>SFHGHCFESKQNKYVYKVCPYKKATQEEGHSTTRLGSWDKFEDSYHIMLE<br>SNGDKCWNGPDRSMKVRLRCGLKNEVTDVDEPSRCEYVALLSTPAVCSRK<br>SERNWNIN- |
| >XP_006445558.1 glucosidase 2 subunit beta [*Citrus clementina*]<br>(SEQ ID NO: 250)<br>MRVVLVDFRFTYAIVLSLLWVSSSVIGRSNAASSLLNDPFYGISPQDENYYKTSSNTIKCKDGSKKFAKTQLNDDYCDCP<br>DGTDEPGTSACPNGKFYCQNAGHSPLMIFSSKVNDGICDCCDGSDEYDGKVKCPNTCWEAGKVARDKLKKKIATYQEGVL<br>LRKKEIEQAKQNLVKDEAELSNLKNEEKILKGLVQQLKERKEQIEKAEEKERLQREKEEKERKEAEENERKEKSESGEKA<br>MQEKNKAEENAYSDDKPDDVRHDDKVGVLEEESFDQGKAENVDEEPATEAKQIGTSQNLGTPVNGVEQHATEEMEQSASS<br>RSKDGSSTVPETSSDAESQMPPEAEKKEEKNLENGVSENTEELSREELGREVASRWTGEKTEKQSGEGGAIANDDQGEDV<br>PEYNHDDEEDRYATDTDDDSERYDTEKYDDNDVEDDIDEPYREEDHDYTSTSYKTDVDDDLDMSEMTTPSSPSWLEKIQQ<br>TVRNILQAVNLFQTPVDKSDAARVRKEYDESSDKLSKIQSRISSLTQKLKHEFGPEKEFYSFYGHCFESKQNKYVYKVCP<br>YKKATQEEGHSTTRLGSWDKFEDSYHIMLESNGDKCWNGPDRSMKVRLRCGLKNEVTDVDEPSRCEYVALLYTPAVCSEE<br>KLQELQHKLDELNKKQPQHHDEL |
| >KDO54514.1 hypothetical protein CISIN_1g006056mg [*Citrus sinensis*]<br>(SEQ ID NO: 251)<br>MRVVLVDERFTYAIVLSLLWVSSSVIGRSNAASSLUNDPFYGISPQDENYYKTSSNTIKCKDGSKKFAKTQENDDYCDCP<br>DGTDEPDCCDGSDEYDGKVKCPNTCWEAGKVARDKLKKKIATYQEGVLLRKKEIEQAKQNLVKDEAELSNLKNEEKILKG<br>LVQQLKERKEQIEKAEEKERLQREKEEKERKEAEENERKEKSESGEKAMQEKNKAEENAYSDDKPDDVRHDDKVGVLEEE<br>SFDQGKAENVDEEPATEAKQIGTSQNLGTPVNGVEQHATEEMEQSASSRSKDGSSTVPETSSDAESQMPPEAEKKEEKNL<br>ENGVSENTEELSREELGRLVASRWTGEKTEKQSGEGGAIANDDQGEDVPEYNHDDEEDRYATDTDDDSERYDTEKYDDND<br>VEDDIDEPYREEDHDYTSTSYKTDVDDDLDMSEMTTPSSPSWLEKIQQTVRNILQAVNLFQTPVDKSDAARVRKEYDESS<br>DKLSKIQSRISSLTQKLKHEFGPEKEFYSFYGHCFESKQNKYVYKVCPYKKATQEEGHSTTRLGSWDKFEDSYHIMLFSN<br>GDKCWNGPDRSMKVRLRCGLKNEVTDVDEPSRCEYVALLYTPAVCSEEKLQELQHKLDELNKKQPQHHDEL |
| >GAY57580.1 hypothetical protein CUMW_180530 [*Citrus unshiu*]<br>(SEQ ID NO: 252)<br>MRVVLVDERFTYAIVESLLWVSSSVIGRSNAASSLLNDPFYGISPQDENYYKTSSNTIKCKDGSKKFAKTQUNDDYCDCP<br>DGTDEPGTSACPNGKFYCQNAGHSPLMIFSSKVNDGICDCCDGSDEYDGKVKCPNTCWEAGKVARDKLKKKIATYQEGVL<br>LRKKEIEQAKQNLVKDEAELSNLKNEEKILKGLVQQLKERKEQIEKAEEKERLQREKEEKERKEAEENERKEKSESGEKA<br>MQEKNKAEENAYSDDKPDDVRHDDKVGVLEEESFDQGKAENVDEEPATEAKQIGTSQNLGTPVNGVEQENGVSENTEELS<br>REELGRLVASRWTGEKTEKQSGEGGAIANDDQGEDVPEYNHDDEEDRYATDTDDDSERYDTEKYDDNDVEDDIDEPYREE<br>DHDYTSTSYKTDVDDDLDMSEMTTPSSPSWLEKIQQTVRNILQAVNLFQTPVDKSDAARVRKEYDESSDKLSKIQSRISS<br>LTQKLKHEFGPEKEFYSFYGHCFESKQNKYVYKVCPYKKATQEEGHSTTRLGSWDKFEDSYHIMLESNGDKCWNGPDRSM<br>KVRLRCGLKNEVTDVDEPSRCEYVALLYTPAVCSEEKLQELQHKLDELNKKQPQHHDEL |
| >KDO54515.1 hypothetical protein CISIN_1g006056mg [*Citrus sinensis*]<br>(SEQ ID NO: 253)<br>MRVVLVDERFTYAIVLSLLWVSSSVIGRSNAASSLLNDPFYGISPQDENYYKTSSNTIKCKDGSKKFAKTQLNDDYCDCP<br>DGTDEPGTSACPNGKFYCQNAGHSPLMIFSSKVNDGICDCCDGSDEYDGKVKCPNTCWEAGKVARDKLKKKIATYQEGVL<br>LRKKEIEQAKQNLVKDEAELSNLKNEEKILKGLVQQLKERKEQIEKAEEKERLQREKEEKERKEAEENERKEKSESGEKA<br>MQEKNKAEENAYSDDKPDDVRHDDKVGVLEEESEDQGKAENVDEEPATEAKQIGTSQNLGTPVNGVEQHATEEMEQSASS<br>RSKDGSSTVPETSSDAESQMPPEAEKKEEKNLENGVSENTEELSREELGRLVASRWTGEKTEKQSGEGGAIANDDQGEDV<br>PEYNHDDEEDRYATDTDDDSERYDTEKYDDNDVEDDIDEPYREEDHDYTSTSYKTDVDDDLDMSEMTTPSSPSWLEKIQQ<br>TVRNILQAVNLFQTPVDKSDAARVRKEYDESSDKLSKIQSRISSLTQKLKHEFGPEKEFYSFYGHCFESKQNKYVYKVCP<br>YKKATQEEGHSTTRLGSWDKFEDSYHIMLESNGDKCWNGPDRSMKVTL |
| >GAY57579.1 hypothetical protein CUMW_180530 [*Citrus unshiu*]<br>(SEQ ID NO: 254)<br>MRVVLVDFRFTYAIVLSLLWVSSSVIGRSNAASSLLNDPFYGISPQDENYYKTSSNTIKCKDGSKKFAKTQLNDDYCDCP<br>DGTDEPGTSACPNGKFYCQNAGHSPLMIFSSKVNDGICDCCDGSDEYDGKVKCPNTCWEAGKVARDKLKKKIATYQEGVL<br>LRKKEIEQAKQNLVKDEAELSNLKNEEKILKGLVQQLKERKEQIEKAEEKERLQREKEEKERKEAEENERKEKSESGEKA<br>MQEKNKAEENAYSDDKPDDVRHDDKVGVLEEESFDQGKAENVDEEPATEAKQIGTSQNLGTPVNGVEQENGVSENTEELS |

TABLE 4-continued

| Polypeptide sequence of citrus plant positive defense regulators |
|---|
| REELGRLVASRWTGEKTEKQSGEGGAIANDDQGEDVPEYNHDDEEDRYATDTDDDSERYDTEKYDDNDVEDDIDEPYREE DHDYTSTSYKTDVDDDLDMSEMTTPSSPSWLEKIQQTVRNILQAVNLFQTPVDKSDAARVRKEYDESSDKLSKIQSRISS LTQKLKHEFGPEKEFYSFYGHCFESKQNKYVYKVCPYKKATQEEGHSTTRLGSWDKFEDSYHIMLFSNGDKCWNGPDRSM KENEFNYKCIVLQVRLRCGLKNEVTDVDEPSRCEYVALLYTPAVCSEEKLQELQHKLDELNKKQPQHHDEL |
| >XP_024958562.1 glucosidase 2 subunit beta isoform X2 [*Citrus sinensis*] (SEQ ID NO: 255) MRVVLVDERFTYAIVLSLLWVSSSVIGRSNAASSLLNDPFYGISPQDENYYKTSSNTIKCKDGSKKFAKTQLNDDYCDCP DGTDEPGTSACPNGKEYCQNAGHSPLMIFSSKVNDGICDCCDGSDEYDGKVKCPNTCWEAGKVARDKLKKKIATYQEGVL LRKKEIEQAKQNLVKDEAELSNLKNEEKILKGLVQQLKERKEQIEKAEEKERLQREKEEKERKEAEENERKEKSESGEKA MQEKNKAEENAYSDDKPDDVRHDDKVGVLEEESFDQGKAENVDEEPATEAKQIGTSQNLGTPVNGVEQHATEEMEQSASS RSKDGSSTVPETSSDAESQMPPEAEKKEEKNLENGVSENTEELSREELGREVASRWTGEKTEKQSGEGGAIANDDQGEDV PEYNHDDEEDRYATDTDDDSERYDTEKYDDNDVEDDIDEPYREEDHDYTSTSYKTDVDDDLDMSEMTTPSSPSWLEKIQQ TVRNILQAVNLFQTPVDKSDAARVRKEYDESSDKLSKIQSRISSLTQKLKHEFGPEKEFYSFYGHCFESKQNKYVYKVCP YKKATQEEGHSTTRLGILFVLPP |
| >KDO54516.1 hypothetical protein CISIN_1g006056mg [*Citrus sinensis*] (SEQ ID NO: 256) MRVVLVDFRFTYAIVLSLLWVSSSVIGRSNAASSLLNDPFYGISPQDENYYKTSSNTIKCKDGSKKFAKTQLNDDYCDCP DGTDEPGTSACPNGKFYCQNAGHSPLMIFSSKVNDGICDCCDGSDEYDGKVKCPNTCWEAGKVARDKLKKKIATYQEGVL LRKKEIEQAKQNLVKDEAELSNLKNEEKILKGLVQQLKERKEQIEKAEEKERLQREKEEKERKEAEENERKEKSESGEKA MQEKNKAEENAYSDDKPDDVRHDDKVGVLEEESFDQGKAENVDEEPATEAKQIGTSQNLGTPVNGVEQHATEEMEQSASS RSKDGSSTVPETSSDAESQMPPEAEKKEEKNLENGVSENTEELSREELGRLVASRWTGEKTEKQSGEGGAIANDDQGEDV PEYNHDDEEDRYATDTDDDSERYDTEKYDDNDVEDDIDEPYREEDHDYTSTSYKTDVDDDLDMSEMTTPSSPSWLEKIQQ TVRNILQAVNLFQTPVDKSDAARVRKEYDESSDKLSKIQSRISSLTQKLKHEFGPEKEFYSFYGHCFESKQNKLLFLTLF SSI |
| >GAY57581.1 hypothetical protein CUMW_180530 [*Citrus unshiu*] (SEQ ID NO: 257) MRVVLVDERFTYAIVLSLLWVSSSVIGRSNAASSLLNDPFYGISPQDENYYKTSSNTIKCKDGSKKFAKTQLNDDYCDCP DGTDEPDCCDGSDEYDGKVKCPNTCWEAGKVARDKLKKKIATYQEGVLLRKKEIEQAKQNLVKDEAELSNLKNEEKILKG LVQQLKERKEQIEKAEEKERLQREKEEKERKEAEENERKEKSESGEKAMQEKNKAEENAYSDDKPDDVRHDDKVGVLEEE SFDQGKAENVDEEPATEAKQIGTSQNLGTPVNGVEQENGVSENTEELSREELGRLVASRWTGEKTEKQSGEGGAIANDDQ GEDVPEYNHDDEEDRYATDTDDDSERYDTEKYDDNDVEDDIDEPYREEDHDYTSTSYKTDVDDDLDMSEMTTPSSPSWLE KIQQTVRNILQAVNLFQTPVDKSDAARVRKEYDESSDKLSKIQSRISSLTQKLKHEFGPEKEFYSFYGHCFESKQNKYVY KVCPYKKATQEEGHSTTRLGSWDKFEDSYHIMLESNGDKCWNGPDRSMKVRLRCGLKNEVTDVDEPSRCEYVALLYTPAV CSEEKLQELQHKLDELNKKQPQHHDEL |
| >StPSL4_PGSC0003DMP400008210 sequence match in blast db Potato PGSC DM v3. 4 protein sequences (SEQ ID NO: 258) MELRFQEVFLLSCIFCICSIDRSVSLPSIVNLGIAPEDENYYKGLSSGAINCKDGSKKFTKAQLNDDECDCPDGSDEPGT SACPSGKFYCKNAGHAPLFIYSSRVNDGICDCCDGSDEHDGKVKCPNTCWEVGRVARDKLKKKIATFQEGIIIRKKETEE AKLAIAKEETEVSKLKNEQKILKGRVEQLQDKKEQIEKVEEEERLKREKEEKERKEADDAKLEASKVEEKTEVHEEAVKS DIHDKIGLLEDSPPVKDVVEGHDKAADEEQHGDHSVKDEFPVDEVEQVPEDSSQHPEIKEASTNNNKADVSSRNEEKDAA ENIESLSKEELGRVIGSRWLGKKSEQETESVEAGTDSNHDNHDEVPSDTHEEEYHGYDSDVDDRKYDDEHKYDDDENKYD DDDNEDHVEDSVGEDHDSSSSYKSESDDSDEADTTTTTSPSWTEKIQQTVKRIFRSVNLFQTPVNISDANCIRKEYDEA SAKLTKIESRLSSLKQKLKHDFGPEKEFYSFHGQCFESKENKYTYKICPFKEATQVEGYSTTRLGNWDKFEDSYRTMQFT NGDHCWNGPNRSVKVKLRCGLKNEVIDIDEPSRCEYLAFLSTPALCLEEKLKELQDKLEMMNREQPQDHDEL |
| LYM2 protein sequences |
| >PtLYM2_Ptrif.0008s0065.2.v1.3.1_*Poncirus_trifoliata* (SEQ ID NO: 259) MGNFQLKLVSLLFTVCAALSTLSTAQDFKCSAQTAARCQALVGYLPENKT TISEIQSLFTVKNLRSILGANNFPPGTRRNFSVPAQKPIKVPIPCICSNG TGVSNKLPVYTVKKDDGLDFIARTIFGQLLKYQKIVEANNISNPDLIQIG QNLTIPLPCSCDDVDNAKVVHYAHVVEEGSSFAIIAQKFGTSRDTLMKLN GIDDDSKLIAGEPLDVPLKACNSSIRADSFDSYLRVANGTYTETANSCVK CQCDATNNWTLQCEPSQFQPSSTHSRWKTCPSMLCGGSESLSIGNATTSN NCNRTTCEYAGYNNLSILTTINSLSTCPSPSNNASRIGSWNLLLISIFLVLLHFHLIQ- |
| >XP_006422460.1 lysM domain-containing GPI-anchored protein 2 isoform X2 [*Citrus clementina*] (SEQ ID NO: 260) MRINKPKPRLFKLQTSNFKSLLSSSAQEEEQDSRGQPHYQCIYNKKLLTTSQRKVNKMGNFQLKLVLLLFTVCAALSTLS TAQDFKCSTQTAARCQALVGYLPPNKTTISEIQSLFTVKNLRSILGANNFPPGTPRNFSVPAQKPIKVPIHCICSNGTGV SDKVPVYTVKKDDGLDFIARTIFGQLLKYQKIVEANNISNPDLIQIGQNLTIPLPCSCDDVDNAKVVHYAHVVEEGSSFE LIAQKFGTDRDTLMKINGIHDDSKLIAGEPLDVPLKACNSSIKADSFDNYLRVANGTYTFTANSCVKCQCDATNNWTLQC KPSQFQPSSPNSRWKTCPSMLCGDSESLSIGNITTSNNCNRTTCEYAGYNNLSILTTENSLSTCPSPSNNASRIGSWNLL LISIFLVLLHFHLIQ |
| >XP_024035093.1 lysM domain-containing GPI-anchored protein 2 isoform X1 [*Citrus clementina*] (SEQ ID NO: 261) MRINKPKPRLFKLQTSNFKSLLSSSAQEEEQDSRGQPHYQCIYNKKLLTTSQRKVNKMGNFQLKLVLLLFTVCAALSTLS TAQDFKCSTQTAARCQALVGYLPPNKTTISEIQSLFTVKNERSILGANNFPPGTPRNFSVPAQKPIKVPIHCICSNGTGV |

TABLE 4-continued

Polypeptide sequence of citrus plant positive defense regulators

SDKVPVYTVKKDDGLDFIARTIFGQLLKYQKIVEANNISNPDLIQIGQNLTIPLPCSCDDVDNAKVVHYAHVVEEGSSFE
LIAQKFGTDRDTLMKINGIHDDSKLIAGEPLDVPLKACNSSIKADSFDNYLRVANGTYTFTANSCVKCQCDATNNWTLQC
KPSQFQPSSPNSRWKTCPSMLCGDSESLSIGNTTTSNNCNRTTCEYAGYNNLSILTTINSLSTCPSKFKLSSHPLECINA
LQIYVLIVSLHWNTILSLQVHWHFI

>XP_006486627.1 lysM domain-containing GPI-anchored protein 2 isoform X2 [*Citrus sinensis*]
(SEQ ID NO: 262)
MGNFQLKLVLLLFTVCAALSTLSTAQDFKCSAQTAARCQALVGYLPPNKTTISEIQSLFTVKNLRSILGANNEPPGTPRN
FSVPAQKPIKVPIHCICSNGTGVSDKVPVYTVKKDDGLDFIARTIFGQLLKYQKIVEANNISNPDLIQIGQNLTIPLPCS
CDDVDNAKVVHYAHVVEEGSSFALIAQKFGTDRDTLMKLNGIHDDSKLIAGEPLDVPLKACNSSIRADSFDNYLRVANGT
YTFTANSCVKCQCDATNNWTLQCEPSQFQPSSPNSRWKTCPSMLCGDSESLSIGNTTTSNNCNRTTCEYAGYNNLSILTT
LNSLSTCPSPSNNASRIGSWNLLLISIFLVLLAFHLIQ >XP_006486626.1 lysM domain-containing GPI-anchored protein 2 isoform X1 [*Citrus sinensis*]
(SEQ ID NO: 263)
MGNFQLKLVLLLFTVCAALSTLSTAQDEKCSAQTAARCQALVGYLPPNKTTISEIQSLFTVKNLRSILGANNEPPGTPRN
FSVPAQKPIKVPIHCICSNGTGVSDKVPVYTVKKDDGLDFIARTIFGQLLKYQKIVEANNISNPDLIQIGQNLTIPLPCS
CDDVDNAKVVHYAHVVEEGSSFALIAQKFGTDRDTLMKLNGIHDDSKLIAGEPLDVPLKACNSSIRADSEDNYLRVANGT
YTFTANSCVKCQCDATNNWTLQCEPSQFQPSSPNSRWKTCPSMLCGDSESLSIGNTTTSNNCNRTTCEYAGYNNLSILTT
LNSLSTCPSKFKLSSHPLFCLNALQIYVLIVSLHWNTILSLQVHWLFI >KDO68285.1 hypothetical protein CISIN_1g0182902mg, partial [*Citrus sinensis*]
(SEQ ID NO: 264)
MGNFQLKLVLLLETVCAALSTLSTAQDFKCSAQTAARCQALVGYLPPNKTTISEIQSLFTVKNLRSILGANNFPPGTPRN
FSVPAQKPIKVPIHCICSNGTGVSDKVPVYTVKKDDGLDFIARTIFGQLLKYQKIVEANNISNPDLIQIGQNLTIPLPCS
CDDVDNAKVVHYAHVVEEGSSFALIAQKFGTDRDTLMKLNGIHDDSKLIAGEPLDVPLKACNSSIKADSFDNYLRVANGT
YTFTANSCVKCQCDATNNWTLQCKPSQFQPSSPNSRWKTCPSMLCGDSESLSIGNTTTSNNCNRTTCEYAGYNNLSILTT
LNSLSTCP >GAY46120.1 hypothetical protein CUMW_094550, partial [*Citrus unshiu*]
(SEQ ID NO: 265)
TGVSNKVPVYTVKKDDGLDFIARTIFGQLLKYQKIVEANNISNPDLIQIGQNLTIPLPCSCDDVDNAKVVHYAHVVEEGS
SFVLIAQKFGTDRDTLMKLNGIHDDSKLIAGEPLDVPLKACNSSIRADSEDNYLRVANGTYTFTANSCVKCQCDATNNWT
LQCEPSQFQPSSPNSRWKTCPSMLCGDSESLSIGNTTTSNNCNRTTCEYAGYNNLSILTTLNSLSTCPSPSNNASRIGSW
NLLLISIFLVLLHFHLIQ >GAY46119.1 hypothetical protein CUMW_094540 [*Citrus unshiu*]
(SEQ ID NO: 266)
MAPSLQFYLPNFIANRVSNKVPVYTVKKDDGLDFIARTIFGQLLKYQKIVEANNISNPDLIQIGQNLTIPLPCSCDDVDN
AKVVHYAHVVEEGSSFVLIAQKFGTDRDTLMKLNGIHDDSKLIAGEPLDVPLKACNSSIRADSEDNYLRVANGTYTFTAN
SCVKCQCDATNNWTLQCEPSQFQPSSPNSRWKTCPSMLCGDSESLSIGNTTTSNNCNRTTCEYAGYNNLSILTTINSLST
CPSPSNNASRIGSWNLLLISIFLVLLHFHLIQ SOT12 protein sequences >PtSOT12.1_Ptrif.0004s0884.1.v1.3.1_*Poncirus_trifoliata*
(SEQ ID NO: 267)
MACQEEGLLLDEYPKEKFWEILDLYQLDGYWYSGDVIPGMLAFKSEFEAL
SDDVILASSMKTGTTWLKALCICIMGNQRKNDGDEVDQLEVKNPHDHIKC
LEYLYYENLLSKLKDMQSPRVENTHLPYSALPELIKNSECKIVYIARNPK
DTFVSLWHFFNQILPPNTEPYPLEKAYNSFIKGIHLEGPFHDHVLEYWQE
SLKNPNKLLFLKYEDLKRDPKGEVRKLASFLGRPFGDDDNDEVDKVLWRS
SFERLKNLEVNKNGKLSDSGVPNSSFFRLGNVGDWQNCFTDEMKQGLDEI
TCKKFEGTGLDL- >PtSOT12.2_Ptrif.0004s0882.1.v1.3.1_*Poncirus_trifoliata*
(SEQ ID NO: 268)
MATASSIPTQELLDQLPKHLHWEAYNIYQWEGFWYPAAVIRGMLAFRSNY
KARCDDVILASSLKTGTTWLKALCACIMDYHDDQLSSKNPHLVVKTLEYE
FAGETLNPDDLSGMSSPRLFHTHLPYSSLPESIKNSECKIVYITRNPSDT
MVSGWHYENRILRRNNQDPYPFEKEYNNFCAGVHSYGPFFYHVLQYWSGS
LKTPSKILFLKYEELKRDPKGQVKRLASFLGRPLAGEDEVDKVIWGSSFE
RLKNLEVNKNGELPFGNVPNSAFLRLGKVGDWENYFTAEMKQGLDEITRM
KLEGSGLDFES- >XP_006485556.1 cytosolic sulfotransferase 12-like [*Citrus sinensis*]
(SEQ ID NO: 269)
MACQEEGLLLDEYPKEKFWEILDLYQLDGYWYSGDVIPGMLAFKSEFKALSDDVILASSMKTGTTWLKALCICIMGNQRK
NDRDEVDQLEVKNPHDHIKCLEYLYYENLLSKLKDMQSPRVENTHLPYSALPESIKNSECKIVYIARNPKDTFVSLWHFF
NQILPPNTEPYRLEKAYDSFIKGIHLFGPFHDHVLEYWQESLKNPNKLLFLKYEDLKRDPKGEVRKLASFLGRPFGDEDN
DEVDKVLWRSSFERLKNLEVNKNGKLSDSGVPNSSFFRLGNVGDWQNCETDEMKQGLDEITCKKFEGTGLDE TABLE 4-continued

| Polypeptide sequence of citrus plant positive defense regulators |
| --- |
| >KDO48723.1 hypothetical protein CISIN_1g037802mg [*Citrus sinensis*] (SEQ ID NO: 270)<br>MACQEEGLLLDEYPKEKFWEILDLYQLDGYWYSGDVIPGMLAFKSEFEALSDDVILASSMKTGTTWLKALCICIMGNQRK<br>NDGDEVDQLEVKNPHDHIKCLEYFYYFNLLSKLKDMQSPRVENTHLPYSALPESIKNSECKIVYIARNPKDTFVSLWHFF<br>NQILPPNTEPYRLEKAYDSFIKGIHLFGPFHDHVLEYWQESLKNPNKLLFLKYEDLKRDPKGEVRKLASFLCRPFGDEDN<br>DEVDKVLWRSSFERLKNLEVNKNGKLSDSGVPNSSFERLGNVGDWQNCFTDEMKQGLDEITCKKFEGSGLDL |
| >XP_024047618.1 cytosolic sulfotransferase 12 [*Citrus clementina*] (SEQ ID NO: 271)<br>MACQEEGLLLDEYPKEKFWEILDLYQLDGYWYSGDVIPGTTWLKALCICIMGNQRKNDRDEVDQLEVKNPHDHIKCLEYL<br>YYFNLLSKLKDMQSPRVENTHLPYSALPESIKNSECKIVYIARNPKDTFVSLWHFENQILPPNTEPYRLEKAYDSFIKGI<br>HLEGPFHDHVLEYWQESLKNPNKLLFLKYEDLKRDPKGEVRKLASFLGRPFGDEDNDEVDKVLWRSSFERLKNLEVNKNG<br>KLSDSGVPNSSFERLGNVGDWQNCFTDEMKQGLDEITCKKFEGTGLDL |

| SCE1 protein sequence |
| --- |
| >PESCE1.1_Ptrif.0005s2463.1.v1.3.1_*Poncirus_trifoliata* (SEQ ID NO: 272)<br>MSGGIARGRLTEERKAWRKNHPHGFVAKPETKDGSVNLMIWECIIPGKTG<br>TDWEGGYFPLTLYFSEDYPSKPPKCKFPQGFFHPNVYPSGTVCLSILNED<br>NGWRPAITVKQILVGIQDLLDQPNPADPAQTDGYQLFIQDPAEYKRRVRL<br>QAKQYPPVL- |
| >PtSCE1.2_Ptrif.0007s0463.1.v1.3.1_*Poncirus_trifoliata* (SEQ ID NO: 273)<br>MSGGIARGRLAEERKSWRKNHPHGFVAKPETLPDGSVNLMVWHCTIPGKA<br>GIDWEGGFFPLTLHFSEDYPSKPPKCKFPQGFFHPNVYPSGTVCLSILNE<br>DNGWRPAITVKQILVGIQDLLDQPNPADPAQTEGYHLFIQDGAEYKRRVR<br>QQAKQYPALL- |
| >ESR47961.1 hypothetical protein CICLE_v10002741mg [*Citrus clementina*] (SEQ ID NO: 274)<br>MSGGGIARGRLTEERKAWRKNHPHTDWEGGYFPLTLYESEDYPSKPPKCKFPQGFFHPNVYPSGTVCLSILNEDNGWRPA<br>ITVKQILVGIQDLLDQPNPADPAQTDGYQLFIQDPAEYKRRVRQQAKQYPPVL |
| >KDO84096.1 hypothetical protein CISIN_1g031420mg [*Citrus sinensis*] (SEQ ID NO: 275)<br>MSGGGIARGRLTEERKAWRKNHPHTDWEGGYFPLTLYFSEDYPSKPPKCKFPQGFFHPNVYPSGTVCLSILNEDNGWRPA<br>ITVKQILVGIQDLLDQPNPADPAQTDGYQLFIQDPAEYKRRVRQQAKQYPPVI |
| >XP_006434720.1 SUMO-conjugating enzyme SCEL isoform X1 [*Citrus clementina*] (SEQ ID NO: 276)<br>MSGGGIARGRLTEERKAWRKNHPHGFVAKPETKDGSVNLMIWECIIPGKTGTDWEGGYFPLTLYFSEDYPSKPPKCKFPQ<br>GFFHPNVYPSGTVCLSILNEDNGWRPAITVKQILVGIQDLLDQPNPADPAQTDGYQLFIQDPAEYKRRVRQQAKQYPPVL |
| >KDO84093.1 hypothetical protein CISIN_1g031420mg [*Citrus sinensis*] (SEQ ID NO: 277)<br>MSGGGIARGRLTEERKAWRKNHPHGFVAKPETKDGSVNLMIWECIIPGKTGTDWEGGYFPLTLYFSEDYPSKPPKCKEPQ<br>GFFHPNVYPSGTVCLSILNEDNGWRPAITVKQILVGIQDLEDQPNPADPAQTDGYQLFIQDPAEYKRRVRQQAKQYPPVI |
| >XP_006473285.1 SUMO-conjugating enzyme SCE1-like isoform X1 [*Citrus sinensis*] (SEQ ID NO: 278)<br>MSGGIARGRLTEERKAWRKNHPHGFVAKPETKDGSVNIMIWECIIPGKTGTDWEGGYFPLTLYFSEDYPSKPPKCKEPQG<br>FFHPNVYPSGTVCLSILNEDNGWRPAITVKQILVGIQDLLDQPNPADPAQTDGYQLFIQDPAEYKRRVRQQAKQYPPVI |
| >XP_006425960.1 SUMO-conjugating enzyme SCE1 [*Citrus clementina*] (SEQ ID NO: 279)<br>MSGGIARGRLAEERKSWRKNHPHGFVAKPETLPDGSVNLMVWHCTIPGKAGTDWEGGFFPLTLHFSEDYPSKPPKCKFPQ<br>GFFHPNVYPSGTVCLSILNEDNGWRPAITVKQILVGIQDLLDQPNPADPAQTEGYHLFIQDAAEYKRRVRQQAKQYPALL |
| >ESR47962.1 hypothetical protein CICLE_v10002741mg [*Citrus clementina*] (SEQ ID NO: 280)<br>MIWECIIPGKTGTDWEGGYEPLTLYFSEDYPSKPPKCKFPQGFFHPNVYPSGTVCLSILNEDNGWRPAITVKQILVGIQD<br>LLDQPNPADPAQTDGYQLFIQDPAEYKRRVRQQAKQYPPVL |
| >KDO84100.1 hypothetical protein CISIN_1g031420mg [*Citrus sinensis*] (SEQ ID NO: 281)<br>MIWECIIPGKTGTDWEGGYFPLTLYFSEDYPSKPPKCKFPQGFFHPNVYPSGTVCLSILNEDNGWRPAITVKQILVGIQD<br>LLDQPNPADPAQTDGYQLFIQDPAEYKRRVRQQAKQYPPVI |
| >XP_024039998.1 SUMO-conjugating enzyme SCEL isoform X2 [*Citrus clementina*] (SEQ ID NO: 282)<br>MSGGGIARGRLTEERKAWRKNHPHGFVAKPETKDGSVNLMIWECIIPGKTGTDWEGGYFPLTLYFSEDYPSKPPKCKFPQ<br>GFFHPNVYPSGTVCLSILNEDNGWRPAITVKQILVGIQDLLDQPNPADPAQTDGYQLFIQ |

TABLE 4-continued

| Polypeptide sequence of citrus plant positive defense regulators |
|---|
| >KDO84097.1 hypothetical protein CISIN_1g031420mg [*Citrus sinensis*] (SEQ ID NO: 283)<br>MSGGGIARGRLTEERKAWRKNHPHGFVAKPETKDGSVNLMIWECIIPGKTGTDWEGGYFPLTLYFSEDYPSKPPKCKEPQ<br>GFFHPNVYPSGTVCLSILNEDNGWRPAITVKQILVGIQDLLDQPNPADPAQTDGYQLFIQVLYWFI |
| >XP_024952076.1 SUMO-conjugating enzyme SCE1-like isoform X2 [*Citrus sinensis*] (SEQ ID NO: 284)<br>MSGGIARGRLTEERKAWRKNHPHGFVAKPETKDGSVNLMIWECIIPGKTGTDWEGGYFPLTLYFSEDYPSKPPKCKFPQG<br>FFHPNVYPSGTVCLSILNEDNGWRPAITVKQILVGIQDLLDQPNPADPAQTDGYQLFIQ |
| >ESR39199.1 hypothetical protein CICLE_v10026671mg [*Citrus clementina*] (SEQ ID NO: 285)<br>MVWHCTIPGKAGTDWEGGFFPLTLHFSEDYPSKPPKCKFPQGFFHPNVYPSGTVCLSILNEDNGWRPAITVKQILVGIQD<br>LLDQPNPADPAQTEGYHLFIQDAAEYKRRVRQQAKQYPALL |
| >KDO84099.1 hypothetical protein CISIN_1g031420mg [*Citrus sinensis*] (SEQ ID NO: 286)<br>MSGGGIARGRLTEERKAWRKNHPHGFVAKPETKDGSVNLMIWECIIPGKTGTDWEGGYFPLTLYFSEDYPSKPPKCKFPQ<br>GFFHPNVYPSGTVCLSILNEDNVSSSCRFVIYEQIMYGSGLAKISSLDDMMAFF |
| >GAY50297.1 hypothetical protein CUMW_125510 [*Citrus unshiu*] (SEQ ID NO: 287)<br>MSGGIARGRLAEERKSWRKNHPHDSIYASFSLGVLHFCHFEVNAVRSSSNQFAGMLGWRPAITVKQILVGIQDLLDQPNP<br>ADPAQTEGYHLFIQDAAEYKRRVRQQAKQYPALL |
| >GAY39565, 1 hypothetical protein CUMW_045300 [*Citrus unshiu*] (SEQ ID NO: 288)<br>MSGGIARGRLTEERKAWRKNHPHGWRPAITVKQILVGIQDLLDQPNPADPAQTDGYQLFIQDPAEYKRRVRQQAKQYPPV |
| **GLY1 protein sequence** |
| >PtGLY1_Ptrif.0004s2683.1.v1.3.1_*Poncirus_trifoliata* (SEQ ID NO: 289)<br>MAASNSIEPRLFLNPIFTTSTTINSPTSLHIQNFKLKLPRFPTKNPTLVF<br>TENSSSGSATTNNNNNDNTIINPYPDDPDPVRVSAVSSENRARDGRDRRK<br>IVKVAWEKLVRWSRTWRSKAKTDILERTNKVVVLGGGSFGTAMAAHLANR<br>KAQLKVYMLMRDPVVCQSINDKHCNCRYFPEQELPENVIATTDAKTALLG<br>ADYCLHAVPVQFSSSFLEGISDYVDPGLPFISLSKGLELNTLRMMSQIIP<br>QALRNPRQPFIALSGPSFALELMNKLPTAMVVASKDRKLANAVQQLLASK<br>HLRISTSSDVTGVEIAGALKNVLAIAAGIVVGMNLGNNSMAALVAQGCSE<br>IRWLATKMGAKPTTITGLSGTGDIMLTCFVNLSRNRTVGVRLGSGEKLDD<br>ILSSMNQVAEGVSTAGAVIALAQKYNVKMPVLTAVARIMDNELTPKKAVL<br>ELMSLPQLFAQPLNSQTISKKKKRNDKMSKKKETVKEILASCCESSLGLD<br>STLCDQLRERLGFEAPTKVQAQAIPVILSGRDVLVNAATGTGKTVAYLAP<br>IINHLQSYSPRIDRSSGTFALVLVPTSELCLLVYEILQKLLHRERWIVPG<br>YVMGGGNRSKEKARLRKGISILVATPGHLLDALKATSSFLATHVRWIIFD<br>EADRILELGFGKEIEEILDILGSRNIGSIGEGNEVSNVKRQNLLLSATIN<br>EKVIHLAKISLETPVLIGLDEKKLPEDKSNVHFGSLESDVKEEVEHPNTT<br>PSSSTEDFKLPAQLVHRYVKDIDRSNEDFDAFFNRLRSGSSVTTGSTSLK<br>GALPLCALGTKIKSQDSSPSGERGTLGTRKRKMGSLFSLPEDFIEGELDP<br>VANKKVSHLAEYVHYTSENITPEVAGEMDKLGLDERYNRALKASQDVTEL<br>LSRSLQDLAAIANVQLENEKLKNELQSYRSYEEKLSRENKTLKGRLNEVS<br>KEKARMVKDLKELQGKHEDLVSQQKEMIDSAFERIMTEVWSIDPGLVVPR<br>VEKWVDKSTILAAIETERESCLLQSGNLQRSSDVPRLLKLMLQLHPAL- |
| >ESR49174.1 hypothetical protein CICLE_v10031473mg [*Citrus clementina*] (SEQ ID NO: 290)<br>MAASNSIEPRLFLNPIFTTSTTTNSSTSLHIQNFKLKLPHFPTKNPTLVETLNSSSGSATTNNNNDNTIITPYPDDPDPE<br>PVSAVSSETRTRDGRDRRKIVKVAWDKLVRWSRTWRSKAKTDILERTNKVVVLGGGSFGTAMAAHVANRKAQLKVYMLMR<br>DPVVCQSINEKHCNCRYFPEQKLPENVIATTDAKTALLGADYCLHAVPVQFSSSFLEGISDYVDPGLPFISLSKGLELNT<br>LRMMSQIIPQALRNPRQPFIALSGPSFALELMNKLPTAMVVASKDRKLANAVQQLLASKALRISTSSDVTGVEIAGALKN<br>VLAIAAGIVVGMNLGNNSMAALVAQGCSEIRWLATKMGAKPATITGLSGTGDIMLTCFVNLSRNRTVGVRLGSGEKLDDI<br>LSSMNQVAEGVSTAGAVIALAQKYNVKMPVLTAVARIIDNELTPKKAVLEIMSLPQVI |
| >ESR49175.1 hypothetical protein CICLE_v10031473mg [*Citrus clementina*] (SEQ ID NO: 291)<br>MAASNSIEPRLFLNPIFTTSTTINSSTSLHIQNFKLKLPHFPTKNPTLVFTENSSSGSATTNNNNDNTIITPYPDDPDPE<br>PVSAVSSETRTRDGRDRRKIVKVAWDKLVRWSRTWRSKAKTDILERTNKVVVLGGGSFGTAMAAHVANRKAQLKVYMLMR<br>DPVVCQSINEKHCNCRYFPEQKLPENVIATTDAKTALLGADYCLHAVPVQFSSSFLEGISDYVDPGLPFISLSKGLELNT<br>LRMMSQIIPQALRNPRQPFIALSGPSFALELMNKLPTAMVVASKDRKLANAVQQLLASKHLRISTSSDVTGVEIAGALKN<br>VLAIAAGIVVGMNLGNNSMAALVAQGCSEIRWLATKMGAKPATITGLSGTGDIMLTCFVNLSRNRTVGVRLGSGEKLDDI<br>LSSMNQVAEGVSTAGAVIALAQKYNVKMPVLTAVARIIDNELTPKKAVLELMSLPQVEEV |

TABLE 4-continued

Polypeptide sequence of citrus plant positive defense regulators

>XP_006435935.2 glycerol-3-phosphate dehydrogenase [NAD(+)] 2, chloroplastic [*Citrus clementina*]
(SEQ ID NO: 292)
MKKKIPILTLKSRSFICEQMAASNSIEPRLFLNPIFTTSTTINSSTSLHIQNFKLKLPHFPTKNPTLVETLNSSSGSATT
NNNNDNTIITPYPDDPDPEPVSAVSSETRTRDGRDRRKIVKVAWDKLVRWSRTWRSKAKTDILERTNKVVVLGGGSFGTA
MAAHVANRKAQLKVYMLMRDPVVCQSINEKHCNCRYFPEQKLPENVIATTDAKTALLGADYCLHAVPVQESSSFLEGISD
YVDPGLPFISLSKGLELNTLRMMSQIIPQALRNPRQPFIALSGPSFALELMNKLPTAMVVASKDRKLANAVQQLLASKHL
RISTSSDVTGVEIAGALKNVLAIAAGIVVGMNLGNNSMAALVAQGCSEIRWLATKMGAKPATITGLSGTGDIMLTCFVNL
SRNRTVGVRLGSGEKLDDILSSMNQVAEGVSTAGAVIALAQKYNVKMPVLTAVARIIDNELTPKKAVLEIMSLPQVEEV >KDO67533.1 hypothetical protein CISIN_19012596mg [*Citrus sinensis*]
(SEQ ID NO: 293)
MAASNSIEPRLFLNPIFTTSTTTNSSTSLHIQNFKLKLPHFPTKNPTLVETLNSSSGSATTNNNNDNTIITPYPDDPDPE
PVSAVSSEIRTRDGRDRRKIVKVAWEKLVRWSRTWRSKAKTDILERTNKVVVLGGGSFGTAMAAHVANKKSQLKVYMLMR
DPAVCQSINEKHCNCRYFREQKLPENVIATTDAKTALLGADYCLHAMPVQFSSSFLEGISDYVDPGLPFISLSKGLEINT
LRMMSQIIPQALRNPRQPFIALSGPSFALELMNKLPTAMVVASKDRKLANAVQQLLASKALRISTSSDVTGVEIAGALKN
VLAIAAGIVVGMNLGNNSMAALVAQGCSEIRWLATKMGAKPATITGLSGTGDIMLTCFVNLSRNRTVGVRLGSGEKLDDI
LSSMNQVAEGVSTAGAVIALAQKYNVKMPVLTAVARIIDNELTPKKAVLEIMSLPQVI >KDO67532.1 hypothetical protein CISIN_1g012596mg [*Citrus sinensis*]
(SEQ ID NO: 294)
MAASNSIEPRLFINPIFTTSTTTNSSTSLHIQNFKLKLPHFPTKNPTLVFTENSSSGSATTNNNNDNTIITPYPDDPDPE
PVSAVSSEIRTRDGRDRRKIVKVAWEKLVRWSRTWRSKAKTDILERTNKVVVLGGGSFGTAMAAHVANKKSQLKVYMLMR
DPAVCQSINEKHCNCRYFREQKLPENVIATTDAKTALLGADYCLHAMPVQFSSSFLEGISDYVDPGLPFISLSKGLELNT
LRMMSQIIPQALRNPRQPFIALSGPSFALELMNKLPTAMVVASKDRKLANAVQQLLASKHLRISTSSDVTGVEIAGALKN
VLAIAAGIVVGMNLGNNSMAALVAQGCSEIRWLATKMGAKPATITGLSGTGDIMLTCFVNLSRNRTVGVRLGSGEKLDDI
LSSMNQVAEGVSTAGAVIALAQKYNVKMPVLTAVARIIDNELTPKKAVLEIMSLPQVEEV >KDO67534.1 hypothetical protein CISIN_1g012596mg [*Citrus sinensis*]
(SEQ ID NO: 295)
MAASNSIEPRLFLNPIFTTSTTTNSSTSLHIQNFKLKLPHFPTKNPTLVETLNSSSGSATTNNNNDNTIITPYPDDPDPE
PVSAVSSEIRTRDGRDRRKIVKVAWEKLVRWSRTWRSKAKTDILERTNKVVVLGGGSFGTAMAAHVANKKSQLKVYMLMR
DPAVCQSINEKHCNCRYFPEQKLPENVIATTDAKTALLGADYCLHAMPVQFSSSFLEGISDYVDPGLPFISLSKGLELNT
LRMMSQIIPQALRNPRQPFIALSGPSFALELMNKLPTAMVVASKDRKLANAVQQLLASKHLRISTSSDVTGVEIAGALKN
VLAIAAGIVVGMNLGNNSMAALVAQGCSEIRWLATKMGAKPATITGLSGTGDIMLTCFVNLSRNRTVGVRLGSGEKLDDI
LSSMNQVLVNPSMQPLLGKL PAL1 protein sequences >PtPAL1.1_Ptrif.0006s0395.1.v1.3.1_*Poncirus_trifoliata*
(SEQ ID NO: 296)
MERGATTENGHQNGSLGGLCKNNNYNYSSGDALNWGVMAETLKGSHLEEV
KRMVAEYRKPVVNLGGETLTVAQVAAIATSSTNVELSESAREGVKASSDW
VMESMNKGTDSYGVTTGFGATSHRRTKNGGALQKELIRFLNAGIEGNGTE
SSHTLPHSATRAAMLVRVNTLLQGYSGIRFEILEAITKLINHNITPCLPL
RGTITASGDLVPLSYIAGLLTGRPNSKATGPNGEIIDAQEASKQAGFGFF
ELQPKEGLALVNGTAVGSGLASMVLFEANNLALLSEILSAIFAEVMQGKP
EFTDHLTHKLKHHPGQIEAAAIMEHILDGSSYVNAAKKLHEIDPLQKPKQ
DRYALRTSPQWLGPQIEVIRFATKSIEREINSVNDNPLIDVSRNKALHGG
NFQGTPIGVSMDNTRLAIAAIGKLMFAQFSELVNDFYNNGLPSNLSGGRN
PSLDYGFKGAEIAMASYCSELQFLANPVTNHVQSAEQHNQDVNSLGLISS
RKTAEAVDILKLMSSTELVAICQAIDERHLEENLKHTVKNTVSQVAKKVL
TVGASGELHPSRECEKDLLKAADHEQVFAYIDDPCSATYPLMQKLRQVLV
EHALNNGENEKTANSSIFQKIAAFEEELKTVLPKEVENARQTVENGSPTI
PNRIKECRSYPLYRFVREELGSNFLTGEKVTSPGEEFDKVFTAMCQGKII
DPMLECLREWNGAPLPIC- >PtPAL1.2_Ptrif.0006s0394.1.v1.3.1_*Poncirus_trifoliata*
(SEQ ID NO: 297)
MDRGAVIENGHQNGCLEGLCKNNNYSSGDALNWGVMAETLKGSHLEEVKR
MVAEYRKPVVNLGGETLTVAQVAAIATAGDVNAQVKVELSESAREGVKAS
SDWVMESMNKGTDSYGVTTGFGATSHRRTKNGGALQKELIRFLNAGIEGN
GTESSHMLPHSATRAAMLVRVNTLLQGYSGIRFEILEAITKLLNHSITPC
LPLRGTITASGDLVPLSYIAGLUTGRPNSKATGPNGEIIDAQEASKQAGF
GFFELQPKEGLALVNGTAVGSGLASMVLFDANNLALLSEILSAIFAEVMQ
GKPEFTDHLTHKLKHHPGQIEAAAIMEHILDGSSYVKAAKKLHEIDPLQK
PKQDRYALRTSPQWLGPQIEVIRFATKSIEREINSVNDNPLIDVSRNKAL
HGGNFQGTPIGVSMDNTRLAIAAIGKLMFAQFSELVNDFYNNGLPSNLSG
GRNPSLDYGFKGAEIAMASYCSELQFLANPVTNHVQSAEQHNQDVNSLGL
ISSRKTAEAVDILKLMSSTFLVALCQAIDERHLEENLKHTVKNTVSQVAK TABLE 4-continued

| Polypeptide sequence of citrus plant positive defense regulators |
|---|

KVLTVGASGELHPSRFCEKDLLKAADREHVFAYIDDPCSATYPLMQKLRQ
VLVDHALNNGENEKNANSSIFQKIAAFEEELKTVLPKEVENARQTVENGS
PTIPNRIKECRSYPLYRLVREELGTNFLTGEKVTSPGEEFDKVFTAMCQG
KIIDPMLECLREWNGAPLPIC-

>PtPAL1.3_Ptrif.0004s0590.2.v1.3.1_*Poncirus_trifoliata*
(SEQ ID NO: 298)
MELSHETCNGINNDRNGGTPSLGLCTGTDPLNWTVAADSLKGSHLDEVKR
MVDEHRRPVVKLGGESLTIGQVTAIAAHDSGVKVELAEAARAGVKASSDW
VMDSMMKGTDSYGVTTGFGATSHRRTKQGGALQKELIRFLNSGIFGNGTE
SSHTLPHSATRAAMLVRVNTLLQGYSGIRFEILETITKFLNANITPCLPL
RGTITASGDLVPLSYIAGLLTGRPNSKAVGPNGQVLNPTEAFNIAGVTSG
FFELQPKEGLALVNGTAVGSGLAATVLFEANILAIMSEVLSAIFAEVMNG
KPEFTDHLTHKLKHHPGQIEAAAIMEHILDGSSYVKAAQKLHEIDPLQKP
KQDRYALRTSPQWLGPQIEVIRAATKMIEREINSVNDNPLIDVSRNKALH
GGNFQGTPIGVSMDNTRLAIASIGKLMFAQFSELVNDFYNNGLPSNLTGG
RNPSLDYGFKGAEIAMASYCSELQFLANPVTNHVQSAEQHNQDVNSLGLI
SSRKTAEAVDILKLMSSTFLVALCQAIDLRHLEENLKNTVKNTVSQVAKR
VLTMGVNGELHPSRECEKDLIKVVDREYVFAYIDDPCSASYPLMQKLRQV
LVDHALDNGDREKNSTTSIFQKIGAFEDELKTLLPKEVEIARTELESGNA
AIPNRIKECRSYPLYKIVREEIGTSLLTGEKVRSPGEEFDKVFVAMCEGK
LIDPMLECLKEWNGAPLPIS- >PtPAL1.4_Ptrif.0008s1965.1.v1.3.1_*Poncirus_trifoliata*
(SEQ ID NO: 299)
MEASLENQSGGNIPSGKLCTNIDPLNWVSASESLKGSHLDEVKRMVSEYR
KPVIRLGGETLTIAQVAAVASRDVGVTVELNEEARAGVKASSDWVMESIN
KGTDSYGITTGFGATSHRRTKQGATLQKELIRFLNAGIFGKGTESCQMLP
HTATRAAMLVRINSLLQGYSGIRFEILEAITKFLNRNITPCLPERASITA
SGDLIHFSYIAGLLTGRPNSVAVGPNGESLNAAEAFSQAGIDGGFFELQP
KEGLALVNGTGVGAGLASIVLFEANILTVLSEVLSAIFAEAMQGKPEFTD
HLTHKLKHHPGQIEAAAIMEHILAGSSCVKAAQILHEIDPLQKPKQDRYA
LRTSPQWLGPQAEVIRASTKSIEREINSVNDNPLIDVSRNKALHGGNFQG
TPIGVSMDNSRLAIASIGKLMFAQFSELVNDFYSNGLPSNLSGGRNPSLD
YGFKGAEIAMAAYCSELQFLANPVTNHVQSAEQHNQDVNSLGLISARKTA
EAVDILKLMSSTYLIALCQAIDLRHLEENLKSTVKNTISQVAKKVLTMGV
NGELHPSRECEKDLLKVVDREYVFSYADDPCSATYPLMQKLRQVLVDHAL
TNNEDLKNANASIFLKIGAFEEELKTLLPKEVESARSAFESGNLEMPNRI
KECRSYPLYRFVREQLGARYLTGEKAISPGEECDKVETAICQGKIIDPLL
ECLKEWDGSPLPIC- >XP_006428759.1 phenylalanine ammonia-lyase [*Citrus clementina*]
(SEQ ID NO: 300)
MEIGATTENGHQNGGLEGLCKNNNYNYSSGDALNWGVMAETLKGSHLEEVKRMVAEYRKPVVNLGGETLTVAQVAAIATS
STNVELSESAREGVKASSDWVMESMNKGTDSYGVTTGFGATSHRRTKNGGALQKELIRFLNAGIEGNGTESSHTLPHSAT
RAAMLVRVNTLLQGYSGIRFEILEAITKLINHNITPCLPLRGTITASGDLVPLSYIAGLLTGRPNSKATGPNGEIIDAQE
ASKQAGFGFFELQPKEGLALVNGTAVGSGLASMVLFEANNLALLSEILSAIFAEVMQGKPEFTDHLTHKLKHHPGQIEAA
AIMEHILDGSSYVNVAKKLHEIDPLQKPKQDRYALRTSPQWLGPQIEVIRFATKSIEREINSVNDNPLIDVSRNKALHGG
NFQGTPIGVSMDNTRLAIAAIGKLMFAQFSELVNDFYNNGLPSNLSGGRNPSLDYGFKGAEIAMASYCSELQFLANPVTN
HVQSAEQHNQDVNSLGLISSRKTAEAVDILKLMSSTFLVALCQAIDLRHLEENLKHTVKNTVSQVAKKVLTVGASGELHP
SRFCEKDLLKAADREHVFAYIDDPCSATYPLMQKLRQVLVEHALNNGENEKTANSSIFQKIAAFEEELKTVLPKEVENAR
QTVENGSPTIPNRIKECRSYPLYRFVREGLGSNFLTGEKVTSPGEEFDKVFTAMCQGKIIDPMLECLREWNGAPLPIC >KDO50673.1 hypothetical protein CISIN_1g005031mg [*Citrus sinensis*]
(SEQ ID NO: 301)
MERGATTENGHQNGGLEGLCKNNNYNYSSGDALNWGVMAETLKGSHLEEVKRMVAEYRKPVVNLGGETLTVAQVAAIATS
STNVELSESAREGVKASSDWVMESMNKGTDSYGVTTGFGATSHRRTKNGGALQKELIRFLNAGIFGNGTESSHTLPHSAT
RAAMLVRVNTLLQGYSGIRFEILEAITKLINHNITPCLPLRGTITASGDLVPLSYIAGLLTGRPNSKATGPNGEIIDAQE
ASKQAGEGFFELQPKEGLALVNGTAVGSGLASMVLFEANNLALLSEILSAIFAEVMQGKPEFTDHLTHKLKHAPGQIEAA
AIMEHILDGSSYVNAAKKLHEIDPLQKPKQDRYALRTSPQWLGPQIEVIRFATKSIEREINSVNDNPLIDVSRNKALHGG
NFQGTPIGVSMDNTRLAIAAIGKLMFAQFSELVNDFYNNGLPSNLSGGRNPSLDYGFKGAEIAMASYCSELQFLANPVTN
HVQSAEQHNQDVNSLGLISSRKTAEAVDILKLMSSTFLVALCQAIDLRHLEENLKHTVKNTVSQVAKKVLTVGASGELHP
SRFCEKDLLKAADREHVFAYIDDPCSATYPLMQKLRQVLVEHALNNGENEKTANSSIFQKIAAFEEELKTVLPKEVENAR
QTVENGSPTIPNRIKECRSYPLYRLVREELGSNFLTGEKVTSPGEEFDKVFTAMCQGKIIDPMLECLREWNGAPLPIC >CAB42794.1 phenylalanine-ammonia lyase [*Citrus clementina* x *Citrus reticulata*]
(SEQ ID NO: 302)
MEIGATTENGHQNGGLEGLCKNNNYNYSSGDALNWGVMAETLKGSHLEEVKRMVAEYRKPVVNLGGETLTVAQVAAIATS
STNVELSESAREGVKASSDWVMESMNKGTDSYGVTTGFGATSHRTTKNGGALQKELIKELNAGIFGNGTKSSHTLPHSAT
RAAMLVRVNTLLQGYSGIRFEILKAITKLENHNITPCLPLRGTITASGDLVPLSYIAGLLTGRPNSKATGPNGQIIDPQE
ASKPAGFGFFELQPKEGLALVNGTAVGSGLASMVLFEANNLALLSEILSAIFAEVMQGKPEFTDHLTHKLKHHPGQTEAA
AIMEHILDGSSYVNVAKKLHEIDPLQKPKQDRYALRTSPQWLGPQIEMIRFATKSIEREINSVNDNPLIDVSRNKALHGG
NFQGTPIGVSMDNTRLAIAAIGKLMFAQFSELVNDFYNNGLPSNLSGGRNPSLDYGEKGAEIAMASYCSELQFLANPVTN
HVHSAEQHNQDVNSLGLISSRKTAEAVDILKLMSSTELVALCQAIDLRHLEENLKHTVKNTVSQVAKKVLIVGASGELHP
SRECEKDLLKAADREHVFAYIDDPCSATYPLMQKLRQVLVEHALNNGENEKTANSSIFQKIAAFEEELKTVLPKEVENAR
QTVENGSPTIPNRIKECRSYPLYRLVREGLGSNFLTGEKVTSPGEEFDKVETAMCQGKIIDPMLECLREWNGAPLPIC TABLE 4-continued

| Polypeptide sequence of citrus plant positive defense regulators |
|---|
| >AIQ80958.1 phenylalanine ammonia-lyase [*Citrus trifoliata*]<br>(SEQ ID NO: 303)<br>MDRGAVIENGHQNGCLEGLCKNNNYSSGDALNWGVMAETLKGSHLEEVKRMVAEYRKPVVNLGGETLTVAQVAAIATAGD<br>VNAQVKVELSESAREGVKASSDWVMESMNKGTDSYGVTTGFGATSHRRTKNGGALQKELIRFLNAGIFGNGTESSHMLPH<br>SATRAAMLVRVNTLLQGYSGIRFEILEAITKLLNHSITPCLPLRGTITASGDLVPLSYIAGLLTGRPNSKATGPNGEIID<br>AQEASKQAGFGFFELQPKEGLALVNGTAVGSGLASMVLFDANNLALLSEILSAIFAEVMQGKPEFTDHLTHKLKHHPGQI<br>EAAAIMEHILDGSSYVKAAKKLHEIDPLQKPKQDRYALRTSPQWLGPQIEVIRFATKSIEREINSVNDNPLIDVSRNKAL<br>HGGNFQGTPIGVSMDNTRLAIAAIGKLMFAQFSELVNDFYNNGLPSNLSGGRNPSLDYGFKGAEIAMASYCSELQFLANP<br>VTNHVQSAEQHNQDVNSLGLISSRKTAEAVDILKLMSSTFLVALCQAIDLRHLEENLKHTVKNTVSQVAKKVLTVGASGE<br>LHPSRFCEKDLLKAADREHVFAYIDDPCSATYPLMQKLRQVLVDHALNNGENEKNANSSIFQKIAAFEEELKTVLPKEVE<br>NARQTVENGSPTIPNRIKECRSYPLYRLVREELGTNELTGEKVTSPGEEFDKVFTAMCQGKIIDPMLECLREWNGAPLPI<br>C |
| >XP_006481493.1 phenylalanine ammonia-lyase [*Citrus sinensis*]<br>(SEQ ID NO: 304)<br>MDRGAVIENGHQNGCLEGLCKDNNYSSGDALNWGVMAETLKGSHLEEVKRMVAEYRKPVVNLGGETLTVAQVAAIATAGD<br>VNAQVKVELSESAREGVKASSDWVMESMNKGTDSYGVTTGFGATSHRRTKNGGALQKELIRFLNAGIFGNGTESSHTLPH<br>SATRAAMLVRVNTLLQGYSGIRFEILDAITKLLNHSITPCLPLRGTITASGDLVPLSYIAGLLTGRANSKATGPNGEIID<br>AQEASKQAGFGFFELQPKEGLALVNGTAVGSGLASMVLFDANNLALLSEILSAIFAEVMQGKPEFTDHLTHKLKHHPGQI<br>EAAAIMEHILDGSSYVKAAKKLHEIDPLQKPKQDRYALRTSPQWLGPQIEVIRFATKSIEREINSVNDNPLIDVSRNKAL<br>HGGNFQGTPIGVSMDNTRLAIAAIGKLMFAQFSELVNDFYNNGLPSNLSGGRNPSLDYGFKGAEIAMASYCSELQFLANP<br>VTNHVQSAEQHNQDVNSLGLISSRKTAEAVDILKLMSSTFLVALCQAIDLRHLEENLKHTVKDTVSQVARKVLTVGANGE<br>LAPSRECEKDLLKAADREHVEAYIDDPCSATYPLMQKLRQVEVEHALNNGENEKNANSSIFQKIAAFEEELKAVLPKEVE<br>NARQTVENGNPTIPNRIKECRSYPLYRLVREELGTNFLTGEKVTSPGEKFDKVETAMCQGKIIDPMLECLREWNGAPLPI<br>C |
| >ESR41998.1 hypothetical protein CICLE_v10011134mg [*Citrus clementina*]<br>(SEQ ID NO: 305)<br>MATLGEPLVDLLSFTPTHYSSSWGIFCDCSNIYAKDMDRGAVIENGHQNGCLEGLCKDNNYSSGDALNWGVMAETLKGSH<br>LEEVKRMVAEYRKPVVNLGGETLTVAQVAAIATAGDVNAQVKVELSESAREGVKASSDWVMESMNKGTDSYGVTTGFGAT<br>SHRRTKNGGALQKELIRFLNAGIFGNGTESSHTLPHSATRAAMLVRVNTLLQGYSGIRFEILDAITKLENHSITPCLPLR<br>GTITASGDLVPLSYIAGLLTGRANSKATGPNGEIIDAQEASKQAGFGFFELQPKEGLALVNGTAVGSGLASMVLFDANNL<br>ALLSEILSAIFAEVMQGKPEFTDHLTHKLKHHPGQIEAAAIMEHILDGSSYVKAAKKLHEIDPLQKPKQDRYALRTSPQW<br>LGPQIEVIRFATKSIEREINSVNDNPLIDVSRNKALHGGNFQGTPIGVSMDNTRLAIAAIGKIMFAQFSELVNDFYNNGL<br>PSNLSGGRNPSLDYGFKGAEIAMASYCSELQFLANPVTNHVQSAEQHNQDVNSLGLISSRKTAEAVDILKLMSSTFLVAL<br>CQAIDERHLEENLKHTVKDTVSQVARKVLTVGANGELHPSRFCEKDLLKAADREHVFAYIDDPCSATYPLMQKLRQVLVE<br>HALNNGENEKNANSSIFQKIAAFEEELKAVLPKEVENARQTVENGNPTIPNRIKECRSYPLYRLVREELGTNFLTGEKVT<br>SPGEKFDKVETAMCQGKIIDPMLECLREWNGAPLPIC |
| >CAB42793.1 phenylalanine-ammonia lyase [*Citrus clementina* x *Citrus reticulata*]<br>(SEQ ID NO: 306)<br>MDRGAVIENGHQNGCLEGLCKDNNYSSGDALNWGVMAETLKGSHLEEVKRMVAEYRKPVVNLGGETLTVAQVAAIATAGD<br>VNAQVKVELSESAREGVKASSDWVMDSMNKGTDSYGVTTGFGATSHRRTQNGGALQKELIKELNAGIFGNGTKSSHTLPH<br>SATRAAMLVRVNTLLQGYSGIRFEILDAITKLLNHSITPCLPLRGTITASGDLVPLSYIAGLLTGRPNSKATGPNGETID<br>AQEASKQAGFGFFELQPKEGLALVNGTAVGSGLASMVLFDANNLALLSEILSAIFAEVMQGKPEFTDHLTHKLKHHPGQI<br>EAAAIMEHILDGSSYVKAAKKLHEIDPLQKPKQDRYALRTSPQWLGPQIEVIRFATKSIEREINSVNDNPLIDVSRNKAL<br>HGGNFQGTPIGVSMDNTRLAIAAIGKLMFAQFSELVNDFYNNGLPSNLSGGRNPSLDYGFKGAEIAMASYCSELQFLANP<br>VINHVQSAEQHNQDVNSLGLISSRKTAEAVDILKLMSSTELVALCQAIDLRHLEENLKHTVKDTVSQVARKVLTVGANGE<br>LHPSRFCEKDLLKAADREHVEAYIDDPCSATYPLMQKLRQVLVEHALNNGENEKNANSSIFQKIAAFEEELKAVLPKEVE<br>NARQTVENGNPTIPNRIKECRSYPLYRLVREELGTNFLTGEKVTSPGEKFDKVFTAMCQGKIIDPMLECEREWNGAPLPI<br>C |
| >AKA60049.1 phenylalanine ammonia-lyase [*Citrus reticulata*]<br>(SEQ ID NO: 307)<br>MDRGAVIENGHQNGCLEGLCKDNNYSSGDALNWGVMAETLKGSHLEEVKRMVAEYRKPVVNLGGETLTVAQVAAIATAGD<br>VNAQVKVELSESAREGVKASSDWVMESMNKGTDSYGVTTGFGATSHRRTKNGGALQKELIRYVFFYIFGNGTESSHTLPH<br>SATRAAMLVRVNTLLQGYSGIRFEILDAITKLLNHSITPCLPLRGTITASGDLVPLSYIAGLLTGRANSKATGPNGEIID<br>AQEASKQAGFGFFELQPKEGLALVNGTAVGSGLASMVLFDANNLALLSEILSAIFAEVMQGKPEFTDHLTHKLKHHPGQI<br>EAAAIMEHILDGSSYVKAAKKLHEIDPLQKPKQDRYALRTSPQWLGPQIEVIRFATKSIEREINSVNDNPLIDVSRNKAL<br>HGGNFQGTPIGVSMDNTRLAIAAIGKLMFAQFSELVNDFYNNGLPSNLSGGRNPSLDYGFKGAEIAMASYCSELQFLANP<br>VTNHVQSAEQHNQDVNSLGLISSRKTAEAVDILKLMSSTFLVALCQAIDLRHLEENLKHTVKDTVSQVARKVLTVGANGE<br>LHPSRECEKDLLKAADREHVFAYIDDPCSATYPLMQKLRQVLVEHALNNGENEKNANSSIFQKIAAFEEELKAVLPKEVE<br>NAGQTVENGNPTIPNRIKECRSYPLYRLVREELGTNFLTGEKVTSPGEKEDKVFTAMCQGKIIDPMLECLREWNGAPLPI<br>C |
| >XP_006436446.1 phenylalanine ammonia-lyase [*Citrus clementina*]<br>(SEQ ID NO: 308)<br>MELSHETCNGINNDRNGGTSSLGLCTGTDPLNWTVAADSLKGSHLDEVKRMVDEYRRPVVKLGGESLTIGQVTAIAAHDS<br>GVKVELAEAARAGVKASSDWVMDSMMKGTDSYGVTTGFGATSHRRTKQGGALQKELIRFLNSGIFGNGTESSHTLPHSAT<br>RAAMLVRVNTLLQGYSGIRFEILETITKELNHNITPCLPLRGTITASGDLVPLSYIAGLLTGRENSKAVGPNGQVLNPTE<br>AFNLAGVTSGFFELQPKEGLALVNGTAVGSGLAATVLFEANILAIMSEVLSAIFAEVMNGKPEFTDHLTHKLKHHPGQIE<br>AAAIMEHILDGSSYVKAAQKLHEIDPLQKPKQDRYALRTSPQWLGPQIEVIRAATKMIEREINSVNDNPLIDVSRNKALH<br>GGNFQGTPIGVSMDNTRLAIASIGKLLFAQFSELVNDFYNNGLPSNLTGGRNPSLDYGFKGAEIAMASYCSELQFLANPV<br>TNHVQSAEQHNQDVNSLGLISSRKTAEAVDILKLMSSTELVALCQAIDLRHLEENLKNTVKNTVSQVAKRVLTMGVNGEL<br>HPSRFCEKDLIKVVDREYVEAYIDDPCSASYPLMQKERQVLVDHALDNGDREKNSTTSIFQKIGAFEDELKTLLPKEVEI<br>ARTELESGNAAIANRIKECRSYPLYKIVREEIGTSLLTGEKVRSPGEEFDKVFAAMCEGKLIDPMLECLKEWNGAPLPIC<br>QN |

TABLE 4-continued

Polypeptide sequence of citrus plant positive defense regulators

>KDO46246.1 hypothetical protein CISIN_19004955mg [*Citrus sinensis*]
(SEQ ID NO: 309)
MELSHETCNGIKNDRNGGTSSLGLCTGTDPLNWTVAADSLKGSHLDEVKRMIDEYRRPVVKLGGESLTIGQVTAIAAHDS
GVKVELAEAARAGVKASSDWVMDSMMKGTDSYGVTTGFGATSHRRTKQGGALQKELIRFLNSGIFGNGTESSHTLPHSAT
RAAMLVRVNTLLQGYSGIRFEILETITKFLNHNITPCLPLRGTITASGDLVPLSYIAGLLTGRPNSKAVGPNGQVINPTE
AFNLAGVTSGFFELQPKEGLALVNGTAVGSGLAATVLFEANILAIMSEVLSAIFAEVMNGKPEFTDHLTHKLKHHPGQIE
AAAIMEHILDGSSYVKAAQKLHEIDPLQKPKQDRYALRTSPQWLGPQIEVIRAATKMIEREINSVNDNPLIDVSRNKALH
GGNFQGTPIGVSMDNTRLAIASIGKLLFAQFSELVNDFYNNGLPSNLTGGRNPSLDYGFKGAEIAMASYCSELQFLANPV
TNHVQSAEQHNQDVNSLGLISSRKTAEAVDILKLMSSTFLVALCQAIDLRHLEENLKNTVKNTVSQVAKRVLTMGVNGEL
HPSRECEKDLIKVVDREYVFAYIDDPCSASYPLMQKLRQVLVDHALDNGDREKNSTTSIFQKIGAFEDELKTLLPKEVEI
ARTELESGNAAIANRIKECRSYPLYKIVREEIGTSLETGEKVRSPGEEFDKVFAAMCEGKLIDPMLECLKEWNGAPLPIC
QN >Q42667.1 RecName: Full = Phenylalanine ammonia-lyase [*Citrus limon*]
(SEQ ID NO: 310)
MELSHETCNGIKNDRNGGTSSLGLCTGTDPLNWTVAADSLKGSHLDEVKRMIDEYRRPVVKLGGESLTIGQVTAIAAHDS
GVKVELAEAARAGVKASSDWVMDSMMKGTDSYGVTTGFGATSHRRTKQGGALQKELIRFLNSGIFGNGTESSHTLPHSAT
RAAMLVRVNTLLQGYSGIRFEILETITKELNHNITPCLPLRGTITASGDLVPLSYIAGLLTGRENSKAVGSNGQVLNPTE
AFNLAGVTSGFFELQPKEGLALVNGTAVGSGLAATVLFEANILAIMSEVLSAIFAEVMNGKPEFTDHLTHKLKHHPGQIE
AAAIMEHILDGSSYVKAAQKLHETDPLQKPKQDRYALRTSPQWLGPQIEVIRAATKMIEREINSVNDNPLIDVSRNKALH
GGNFQGTPIGVSMDNTRLAIASIGKLMFAQESELVNDFYNNGLPSNLTGGRNPSLDYGEKGAEIAMASYCSELQFLANPV
TNHVQSAEQHNQDVNSLGLNSSRKTAEAVDILKLMSSTFLVALCQAIDERHLEENLKNTVKNTVSQVAKRVETMGVNGEL
HPSRFCEKDLIKVVDREYVFAYIDDPCSASSPLMQKLRQVLVDHALDNGDREKNSTTSIFQKIGAFEDELKTLLPKEVEI
ARTELESGNAAIPNRIKECRSYPLYKIVREDIGTSLLTGEKVRSPGEEFDKVFTAMCEGKLIDPMLECLKEWNGAPLPIC
QN >XP_006424540.1 phenylalanine ammonia-lyase [*Citrus clementina*]
(SEQ ID NO: 311)
MEASHENQSGGNIPSGKLCTNIDPLNWVSASESLKGSHLDEVKRMVSEYRKPVVRLGGETLTIAQVAAVASRDDGVTVEL
NEEARAGVKASSDWVMESMNNGTDSYGVTTGFGATSHRRTKQGAALQKELIRFLNAGIFGKGTESCHMLPHTATRAAMLV
RINTLLQGYSGIRFEILEAITKFLNRNITPCLPLRASITASGDLVPFSYIAGLLTGRPNSVAVGPNGESLNAAEAFSQAG
IDGGFFELQPKEGLALVNGTGVGAGLASIVLFEANILTVLSEVISAIFAEAMHGKPEFTDHLTHKLKHHPGQIEAAAIME
HILDGSSYVKAAQKLHEIDPLQKPKQDRYALRTSPQWLGPQAEVIRASTKSIEREINSVNDNPLIDVSRNKALHGGNFQG
TPIGVSMDNSRLAIASIGKLMFAQFSELVNDFYSNGLPSNLSGGRNPCLDYGFKGAEIAMAAYCSELQFLANPVTNHVQS
AEQHNQDVNSLGLISARKTAEAVDILKLMSSTYLIALCQAIDLRHLEENLKSTVKSTISQVAKKVLTMGVNGELHPSRFC
EKDLLKVVDREYVESYADDPCSATYPLMQKLRQVLVDHALINNEDLKNANASIFLKIGAFEEELKTLLPKEVESARSAFE
SGNLEIPNRIKECRSYPLYRFVREELGARYLTGEKAISPGEECDKVFTAICQGKIIDPLLECLKEWDGSPLPIC >XP_006424538.1 phenylalanine ammonia-lyase 1 [*Citrus clementina*]
(SEQ ID NO: 312)
MEASHENQSGGNIPSGKLCTNIDPLNWVSASESLKGSHLDEVKRMVSEYRKPVVRLGGETLTIAQVAAVASRDDGVTVEL
NEEARAGVKASSDWVMESMNNGTDSYGVTTGFGATSHRRTKQGAALQKELIRFLNAGIFGKGTESCHMLPHTATRAAMLV
RINTLLQGYSGIRFEILEAITKFLNRKITPCLPLRASITASGDLVPFSYIAGLLTGRPNSVAVGPNGESLNAAEAFSQAG
IDGGFFELQPKEGLALVNGTGVGAGLASIVLFEANILTVLSEVISAIFAEAMQGKPEFTDHLTHKLKHHPGQIEAAAIME
HILDGSSYVEAAQKFHEIDPLQKPKQDRYALRTSPQWLGPQAEVIRASTKSIEREINSVNDNPLIDVSRNKALHGGNFQG
TPIGVSMDNSRLAIASIGKLMFAQFSELVNDFYSNGLPSNLSGGRNPCLDYGFKGAEIAMAAYCSELQFLANPVTNHVQS
AEQHNQDVNSLGLISARKTAEAVDILKLMSSTYLIALCQAIDLRHLEENLKSTVKNTISQVAKKVLTMGVNGELHPSRFC
EKDLLKVVDREYVFSYADDPCSATYPLMRKLRQVLVDHALTNNEDLKNANASIFLKIGAFEEELKTLLPKEVESARSAFE
SGNLEIPNRIKECRSYPLYREVREELGARYLTGEKAISPGEECDKVFTAICQGKIIDPLLECLKEWDGSPLPIC >XP_006488063.1 phenylalanine ammonia-lyase-like [*Citrus sinensis*]
(SEQ ID NO: 313)
MEASHENQSGGNIPSGKLCTNIDPLNWVSASESLKGSHLDEVKRMVSEYRKQVVRLGGETLTIAQVAAVASRDGGVTVEL
NEEARAGVKASSDWVMESMNKGTDSYGITTGFGATSHRRTKQGAALQKELIRFLNAGIEGKGTESCQMLPHTATRAAMLV
RINTLLQGYSGIRFEILEAITKFLNRNITPCLPLRASITASGDLIPFSYIAGLLTGRINSVAVGPNGESLNAAEAFSQAG
IDGGFFELQPKEGLALVNGTGVGAGLASIVLFEANILTVLSEVLSAIFAEAMLGKPEFTDHLTHKLKHHPGQIEAAAIME
HILDGSSYVKAAQKLHEIDPLQKPKQDRYALRTSPQWLGPQAEVIRASTKSIEREINSVNDNPLIDVSRNKALHGGNEQG
TPIGVSMDNSRLAIASIGKLMFAQFSELVNDFYSNGLPSNLSGGRNPSLDYGFKGAEIAMAAYCSELQFLANPVTNHVQS
AEQHNQDVNSLGLISARKTAEAVDILKLMSSTYLIALCQAIDLRHLEENLKSTVKNTISQVVKKVLTMGVNGELHPSREC
EKDLLKVVDREYVFSYADDPCSATYPLMQKLRQVLVDHALTNNEDLKNANASIFLKIGAFEEELKTLLPKEVESARSAFE
SGNLEIPNRIKECRSYPLYRFVREELGARYLTGEKAISPGEECDKVFTAICQGKIIDELLECLKEWDGSPLPIC >KDO50672.1 hypothetical protein CISIN_1g037382mg [*Citrus sinensis*]
(SEQ ID NO: 314)
MLVRVNTLLQGYSGIRFEILEAITKLLNHSITPCLPLRGTITASGDLVPLSYIAGLLTGRPNSKATGPNGETIDAQEASK
QAGFGFFELQPKEGLALVNGTAVGSGLASMVLEDANNLALLSEILSAIFAEVMQGKPEFTDHLTHKLKHHPGQIEAAAIM
EHILDGSSYVKAAKKLHEIDPLQKPKQDRYALRTSPQWLGPQIEVIRFATKSIEREINSVNDNPLIDVSRNKALHGGNFQ
GTPIGVSMDNTRLAIAAIGKLMFAQFSELVNDFYNNGLPSNLSGGRNPSLDYGFKGAEIAMASYCSELQFLANPVTNHVQ
SAEQHNQDVNSLGLISSRKTAEAVDILKLMSSTELVALCQAIDERHLEENLKHTVKDTVSQVARKVLTVGANGELHPSRE
CEKDLLKAADREHVFAYIDDPCSATYPLMQKLRQVLVEHALNNGENEKNANSSIFQKIAAFEEELKAVLPKEVENARQTV
ENGNPTIPNRIKECRSYPLYRLVREELGTNFLTGEKVTSPGEEFDKVFTAMCQGKIIDPMLECLWEWNGAPLPIC >GAY59766.1 hypothetical protein CUMW_197020, partial [Citrus unshiu]
(SEQ ID NO: 315)
MEPKEGLALVNGTGVGAGLASIVLFEANILTVLSEVISAIFAEAMHGKPEFTDHLTHKLKHHPGQIEAAAIMEHILDGSS
YVEAAQKFHEIDPLQKPKQDRGGNIPSGKLCTNIDPLNWVSASESLKGSHLDEVKRMRVPEAGGEARRRDPDDSSGGAVA TABLE 4-continued Polypeptide sequence of citrus plant positive defense regulators RVSRDGGVTVELNEEARAGVKASSDWVMESMNKGTDSYGITTGFGATSHRRTKQGAALQKELIRFLNAGIFGKGTESCQM
LPHTATRAAMLVRINTLLQGYSGIRFEILEAITKELNRNITPCLPLRASITASGDLIPFSYIAGLLTGRENSVAVGPNGE
SLNAAEAFSQAGIDGGFFELQPKEGLALVNGTGVGAGLASIVLFEANILTVLSEVLSAIFAEAMLGKPEFTDHLTHKLKH
HPGQIEAAAIMEHILDGSSYVKAAQKLHEIDPLQKPKQDRYALRTSPQWLGPQAEVIRASTKSIEREINSVNDNPLIDVS
RNKALHGGNFQGTPIGVSMDNSRLAIASIGKLMFAQFSELVNDFYSNGLPSNLSGGRNPSLDYGFKGAEIAMAAYCSELQ
FLANPVINHVQSAEQHNQDVNSLGLISARKTAEAVDILKLMSSTYLIALCQAIDERHLEENLKSTVKNTISQVVKKVLTM
GVNGELHPSRECEKDLLKVVDREYVESYADDPCSATYPLMQKLRQVLVDHALINNEDLKNANASIFLKWIKECRSYHCIG
WGSVSDRSEGDYHQARNVIRCLQRFVGKILIQ WRKY70 protein sequences >PtWRKY70_Ptrif.0006s1042.1.v1.3.1_*Poncirus_trifoliata*
(SEQ ID NO: 316)
MEAGQATSSSSWLENSSVSSDRRRAIEELIKGQEMALQLRNLIHKSTKSG
EGSKGMIINQDLVANILSSFTNSLSILKNGDSDEASQVQEHTQLSSPCWE
AYLKTEDSGESSKSSTVKDRRGCYKRRKCAESWTEHSSTLTDDGEAWRKY
GQKVILNAKFPRNYFRCTHKEDQGCLASKQVQKIQEEPPVHRTTYYGRHT
CKSLIKSSQLMLDSTTSDQCPMISFGSAHITENDENPESSSFPSIKQESN
KDDQAPLSDMTRNQSSSSDEYIVSPDFPAFESNEHMKVLSADHGDVISGV
NSSCTASAHSLDLAVDMSVNFDDVLEFNFDA- >ESR42836.1 hypothetical protein CICLE_v10012055mg [*Citrus clementina*]
(SEQ ID NO: 317)
MLLTYLKASICLESFATPTWKKRGKKIIMKMEAGQATSSSSWLENSSDRRRAIEELIKGQEMALQLRNLIHKSTKSGEGS
KAMIINQDLVANILSSFTNSLSILKNGDSDEASQVQEHTQLSSPCWEAYLKTEDSGESSKSSTVKDRRGCYKRRKCAESW
TEHSSTLTDDGHAWRKYGQKVILNARFPRNYFRCTHKFDQGCQASKQVQRIQEEPPLHRTTYYGRHTCKSLIKSSQLMLD
STTSDQCPMISFGSAHITEKDENPFLSSEPSIKQESNKDDQGPLSDMTHNQSSSSDEYLVSHDFPAFESNEHMKVLSSDH
GDVISGVNSSCTASAHSLDLAVDMSVNFDDVLEENE >GAY32270.1 hypothetical protein CUMW_001510 [*Citrus unshiu*]
(SEQ ID NO: 318)
MLLTYLKASICLESFATPTWKKRGKKIIMKMEAGQATSSSSWLENSSDRRRAIEELIKGQEMALQLRNLIHKSTKSGEGS
KAMIINQDLVANILSSETNSLSILKNGDSDEASQVQEHTQLSSPCWEAYLKTEDSGESSKSSTVKDRRGCYKRRKCAESW
TEHSSTLTDDGHAWRKYGQKVILNARFPRNYFRCTHKEDQGCQASKQVQRIQEEPPLYRTTYYGRHTCKSLIKSSQLMLD
STTSDQCPMISFGSAHITEKDENPFLSSEPSIKQESNKDDQAPLSDMTHNQSSSSDEYLVSHDFPAFESNEHMKVLSSDH
GDVISGVNSSCTASAHSLDLAVDMSVNEDDVLEFNE >XP_006429596.2 probable WRKY transcription factor 70 [*Citrus clementina*]
(SEQ ID NO: 319)
MKMEAGQATSSSSWLENSSDRRRAIEELIKGQEMALQLRNLIHKSTKSGEGSKAMIINQDLVANILSSETNSLSILKNGD
SDEASQVQEHTQLSSPCWEAYLKTEDSGESSKSSTVKDRRGCYKRRKCAESWTEHSSTLTDDGHAWRKYGQKVILNARFP
RNYFRCTHKEDQGCQASKQVQRIQEEPPLHRTTYYGRHTCKSLIKSSQLMLDSTTSDQCPMISFGSAHITEKDENPELSS
FPSIKQESNKDDQGPLSDMTHNQSSSSDEYLVSHDFPAFESNEHMKVLSSDHGDVISGVNSSCTASAHSLDLAVDMSVNF
DDVLEENE >KDO64116. 1 hypothetical protein CISIN_1g020291mg [*Citrus sinensis*]
(SEQ ID NO: 320)
MKMEAGQATSSSSWLENSSDRRRAIEELIKGQEMALQLRNLIHTSTKKGEGSKAMIINQDLVANILSSFTNSLSILKNGD
SDEASQVQEHTQLSSPCWEAYLKTEDSGESSKSSTVKDRRGCYKRRKCAESWTEHSSTLTDDGHAWRKYGQKVILNAREP
RNYFRCTHKEDQGCQASKQVQRIQEEPPLHRTTYYGRHTCKSLIKSSQLMLDSTTSDQCPMISFGSAHITEKDENPFLSS
FPSIKQESNKDDQGPLSDMTHNQSSSSDEYLVSHDFPAFESNEHMKVLSSDHGDVISGVNSSCTASAHSLDLAVDMSVNF
DDVLEENE >ANA95961.1 WRKY transcription factor [*Citrus maxima*]
(SEQ ID NO: 321)
MKMEAGQATSSSSWLENSSDRRRAIEELIKGQEMALQLRNLIHTSTKKGEGSKAMIINQDLVANILSSFINSLSILKNGD
SDEASQVQEHTQLSSPCWEAYLKTEDSGESSKSSTVKDRRGCYKRRKCAESWTEHSSTLTDDGHAWRKYGQKVILNARFP
RNYFRCTHKFDQGCQASKQVQRIQEEPPVYRTTYYGRHTCKSLIKSSQLMEDSTTSDQCPMISFGSAHITEKEFNPFLSS
FPSKKQESNKDDQAPLSDMTHNQSSSSDEYLVSPDFPAFESNEHMKVLSSDHGDVISGVNSSCTASAHSLDLAVDMSVNF
DDVLEENEDA >AKA59519.1 WRKY70 [*Citrus japonica*]
(SEQ ID NO: 322)
MKMEAGQATSSSSWLENSSDRRRAIEELIKGQEMALQLRNLIHTSTKKGEGSKAMIINQDLVANILSLFTNSLSILKNGD
SDEASQVQEHTQLSSPCWEAYLKTEDSGESSKSSTVKDRRGCYKRRKCAESWTEHSSTLTDDGFAWRKYGQKVILNSKEP
RNYFRCTHKEDQGCQASKQVQRIQGEPPLYRTTYYGRATCKSLIKSSQLMPDSTTSDQCPMISFGSAHITEKDENPELSS
FPSIKQESNKDDQAPLSDMTHNQSSSSDEYLVSHDFPAFESNEHMKVLSSDHGDVISGVNSSCTASAHSLDLAVDMSVNE
DDVLEFNE EFR-like protein sequences >PtEFR_Ptrif.0007s1284.1.v1.3.1_*Poncirus_trifoliata*
(SEQ ID NO: 323)
MCSNLYIINKALTACSLSILHEWLFLRVNTWEIPLEIGNLQNLEELSLGL
NKLIGTVPVAIFNVSTLKILELGGNSLSGSLSSIADVRLPNLEVLLLWGN
NESGTIPRFIFNASKLSILDLQYNSESSFIPNTEGNLRNLEGLYLQDNYL
TSSTPELSFLSSLSNCKSLTAIGLSNNPLDGILPKTSIGNHSYSLEDLEM TABLE 4-continued

| Polypeptide sequence of citrus plant positive defense regulators |
|---|
| HNCNVSGGIPEEIGNETNLITIDLGGNKLNGSILITLSKLQKLQGLVLDD<br>NKLEGSIPDDICRLVELYKLELGGNKLSGSIPACESNLIALRILSLGSNE<br>LTSIPLTEWNLKDILYLNFSSNCFTGPLPLEIGNLKVLVGIDESMNNFSG<br>IIPKEIGGLNYLEYLELGYNRLQGSIPDSEGNLISLKELNLSNNNLSGAI<br>PASLEKLSYLEDINLSENKLEGEIPWGGSEGNESVESFEGNELLCGSPNL<br>QVPPCKTSIHHTSWKTSLLLGIVLPLSTTLMIVVIWLIWLAHMYRATDGE<br>SENNLIGRGGFGSVYKARLGDGMEVAVKVENLQCRRAFKSFDVECEIMKS<br>IRHRNLIKVISSCSNEDFKGLVLEYMPQGSLEKHLYSSNCILDIFQRLNI<br>MIDVASALEYLHFGCSTPVIHCDLKPSNVLLDDNMVAYLSDFGIAKLLIG<br>EDQSMTQTQTLATIGYMAPEYGREGRVSTNGDVYSFGIMLMETFTGKKPT<br>DEIFNGEMTLKHWVNDWLPISTMEVVDANLLSQEDVHFVAKEQCVSEVEN<br>LAMACTVESHEQRINAKEIVTKLLKIRDSLLRNVGGIRIRQPNLN- |
| >ESR49607.1 hypothetical protein CICLE_v10033608mg [*Citrus clementina*]<br>(SEQ ID NO: 324)<br>MLREHAVAGEQAEDMLQVLGVPTAGLEDTCQDLGGGERGVGPNLPDGIRYMETDGSGEIPLEIGNLQNLEVLDLGQNKLI<br>GTVPAAIFNVSTLKFIELQDNSLSGSLSSITDVRLPNLEKLHLWELSFLSSLSNCKSETLIDLSNNPLDGILPKTSIGNL<br>SHSLKDFKMHNCNVSGGIPEEISRLTNLTTIDLGGNKLNGSIPITLSKLQKLQGLGLEDNKLEGSIPDSICRLTELYDLE<br>LGGNKLFGSIPACFSNLASERILSLGSNELTSIPLTFWNINDILYLNFSSKFFTAPLPLEIGNLKVLVGMDFSMNNESGV<br>IPTKIGGLNNLEYLFLGYNKLQGSILDSFGDLISLKSENLSNNNLSGAIPASLEKLSYLEDENLSENKLEGEILMGGSEG<br>NFSAESFEGNELLCGSPNLQVPPCKTSIHRTSWKNSLLLGIVLPLSTIEMIVVILLGDEMEVAVKVENLQCGRAFKSFDV<br>ECEIMKSIRHRNLIKVISSCSNEELNIMIDVASALEYLHFGHSAPIIHCDLKPSNVLLDDNMVAHLSDESITKLLTREDQ<br>SMTQTQTFATIVYMAPEYGREGRVSANGDVYSFGDYVNGNFYWGRTHRWRGGSGAMTLKQWVVDVNLLSQEDVHFVAKEQ<br>CVSFVENLAMACTVESPEQRINAKEIVTMLLKIRGSLLRNCDLNY |
| >GAY66412.1 hypothetical protein CUMW_248560, partial [*Citrus unshiu*]<br>(SEQ ID NO: 325)<br>MIFSKLDRATARSSPRAGPPLLRMMSRFLLLHCLILISLFIAAATANTSSTITDRDALLALKAHITHDPTNFLAKNWNTS<br>TPVCNWTGVVCDVHSHRVTVENISSLNLTGTIPSQLGNLSSLQSLNLSCNRLSGSIPSAIFTIYTLKYVSFRENQVSGQI<br>PANICSNLPFLDYLSLAKNMEHGGIPSALSNCTYLQILHLSYNDESGAVPKDIGNLSKLKELYLGRNRLQGEIPREEGNL<br>TELEQMSLSENELQEHAVAGEQAEDMLQVLGVPTAGLEDTCQDLGGGERGVGPNLPDGIRYMETDGSGEIPLEIGNLQNI<br>EVLDLGQNKLIGTVPAAIFNVSTLKFIELQDNSLSGSLSSITDVRLPNLEKLHLWELSFLSSLSNCKSLTLIDLSNNPLD<br>GILPKTSIGNLSHSLKDFKMHNCNVSGGIPEEISRLTNLITIDLGGNKINGSIPITLSKLQKLQGLGLEDNKLEGSIPDS<br>ICRLTELYDLELGGNKLFGSIPACFSNLASLRILSLGSNELTSIPLTFWNINDILYLNESSNFFTAPLPLEIGNLKVLVG<br>MDFSMNNESGVIPTKIGGLKNLEYLFLGYNKLQGSILDSEGDLISLKSINLSNNNLSGAIPASLEKLSYLEDINLSENKL<br>EGEILMGGSEGNESAESFEGNELLCGSPNLQVPPCKTSIHRTSWKNSLLLGIVLPLSTIFMIVARLGDEMEVAVKVENLQ<br>CGRAFKSEDVECEIMKSIRHRNLIKVISSCSNEELNIMIDVASALEYLHFGHSAPIIHCDLKPSNVLLDDNMVAHLSDES<br>IAKLLTGEDQSMTQTQTFATIGYMAPEYGREGRVSANGDVYSEGIMLMETFTGKKPTDEIFNEEMTLKQWEDVHFVAKEQ<br>CVSFVFNLAMACTVESPEQRINAKEIVTKLLKIRGSLLRNVGGR |
| >GAY66414.1 hypothetical protein CUMW_248560 [*Citrus unshiu*]<br>(SEQ ID NO: 326)<br>MIFSKLDRATARSSPRAGPPLLRMMSRFLLLHCLILISLFIAAATANTSSTITDRDALLALKAHITHDPINFLAKNWNTS<br>TPVCNWTGVVCDVHSHRVTVLNISSLNLTGTIPSQLGNLSSLQSLNLSCNRLSGSIPSAIFTIYTLKYVSFRENQVSGQI<br>PANICSNLPELDYLSLAKNMFHGGIPSALSNCTYLQILHLSYNDESGAVPKDIGNLSKLKELYLGRNRLQGEIPREFGNL<br>TELEQMSLSENELQGEIPLEIGNLQNLEVLDLGQNKLIGTVPAAIFNVSTIKFIELQDNSLSGSLSSITDVRLPNLEKLH<br>LWEFSKNSESGFIPNTEGNERNLQKLRLYDNYLTSLTPELSFLSSLSNCKSLTLIDLSNNPLDGILPKTSIGNLSHSLKD<br>FKMHNCNVSGGIPEEISRLTNLTTIDEGGNKLNGSIPITLSKLQKLQGLGLEDNKLEGSIPDSICRLTELYDLELGGNKL<br>FGSIPACESNLASLRILSLGSNELTSIPLTFWNLNDILYLNFSSNFFTAPLPLEIGNLKVLVGMDFSMNNFSGVIPTKIG<br>GLKNLEYLFLGYNKLQGSILDSEGDLISLKSLNLSNNNLSGAIPASLEKLSYLEDLNLSENKLEGEILMGGSFGNFSAES<br>FEGNELLCGSPNLQVPPCKTSIHRTSWKNSLLLGIVEPLSTIFMIVVILLILRY |
| >GAY66413.1 hypothetical protein CUMW_248550 [*Citrus unshiu*]<br>(SEQ ID NO: 327)<br>MIFSKLDRATARSSPRAGPPLLRMMSRFLLLHCLILISLFIAAATANTSSTITDRDALLALKAHITHDPTNFLAKNWNTS<br>TPVCNWTGVVCDVHSHRVTVLNISSLNLIGTIPSQLGNLSSLQSLNLSCNRLSGSIPSAIFTIYTLKYVSFRENQVSGQI<br>PANICSNLPFLDYLSLAKNMEHGGIPSALSNCTYLQILHLSYNDESGAVPKDIGNLSKLKELYLGRNRLQGEIPREEGNL<br>TELEQMSLSENELQEHAVAGEQAEDMLQVLGVPTAGLEDTCQDLGGGERGVGPNLPDGIRYMETDGSGEIPLEIGNLQNL<br>EVLDLGQNKLIGTVPAAIFNVSTLKFIELQDNSLSGSLSSITDVRLPNLEKLHLWGNNFSGTIPRFIFNASKLSILEFSK<br>NSFSGFIPNTFGNLRNLQKLRLYDNYLTSLTPELSFLSSLSNCKSLTLIDESNNPLDGILPKTSIGNLSHSLKDEKMANC<br>NVSGGIPEEISRLTNETTIDIGGNKLNGSIPITLSKLQKLQGLGLEDNKLEGSIPDSICRLTELYDLELGGNKLFGSIPA<br>CFSNLASLRILSEGSNELTSIPLTFWNLNDILYLNFSSNFFTAPLPLEIGNLKVLVGMDFSMNNESGVIPTKIGGLKNLE<br>YLFLGYNKLQGSILDSFGDLISLKSLNLSNNNLSGAIPASLEKLSYLEDLNLSENKLEGEILMGGSFGNFSAESFEGNEL<br>LCGSPNLQVPPCKTSIHRTSWKNSLLLGIVEPLSTIEMIVVILLILRY |
| >GAY68230.1 hypothetical protein CUMW_262510 [*Citrus unshiu*]<br>(SEQ ID NO: 328)<br>MCSNLYITNKALTVCSLPILHEWLFFCVREIPPEIGNLRNLEELDLGHNKLVGTVPAAIFNLSTLKEFSIPNNSLSGCLS<br>SIADVRLPNLEVINEWELSFLSSLSNCKSLTYIDLSYNPLDSILPRTSVGNLSHSLEDFEMNNCNVSGGIPEEISNLTNL<br>TTIDLGGNKLNGLIPITLSKLQKLQGLVLYDNKLEGSIPDDICRLAELYELELDGNKLSGSIPACLSNLISLRILSLGSN<br>ELTSIPLTEWNLEDILYLNESSNFLTGPLPLEIGKLKVLVGIDESMNNESGVIPTKIGGLKNLEYLFLGYNRLQGSIPDS<br>FGDLTSLKSLNLSNNNLSGTIPASLEKLSYLENLNLSENKLEGEIPRGGSFGKFSAESFKGNELLCGSPNLQVPPCKTSI<br>HHTSWKNSLLLGIVLPLTRLGDGMEVAVKVENLECGRAFKSFDVECDMMKSIRHRNLIKVISSCSNEELNIMIDVASALE<br>YLHFGYSAPVIHCDLKPSNVLLDDNMVAHLSDFSIAKLLTGEDQSMTQTQTLATIGYMAPEYGREGRVSANGDVYSFGIM<br>LMETFTGKKPTDEIFNEEMTLKHWEDIHFVAKEQCVSEVENLAMACTVESPEQRINAKEIVTKLLKIRDSLLRNVGGRES<br>LVLSRFIEVSSFLEGKGKCYLLLTDYEYENLTCETVISAI |

TABLE 4-continued

| Polypeptide sequence of citrus plant positive defense regulators |
|---|
| >GAY68422.1 hypothetical protein CUMW_263980 [*Citrus unshiu*] (SEQ ID NO: 329) MERAHSLMMMSRFLLLHCLILISLFIAAATANTSSTITDQDALLALKAHITHDPINFLAKNWNTSTPVCNWTGVACEVHS QRVTVLNISSLNETGTIPSQLGNLSSLQSLNLSENRLEGSIPSAIFTTYTLKYVCLRGNQLSGTFPSFISNKSSLQHLDL SSNALSGEIRANICSNLPFLEYLAFFKNMLHGGIPSTLSNCTYLRTLDFSYNDFSEAIPKDIGNITNLKELYLGRNRLQG EIPREFGNLPELELMSLAANNLQGKIPLKIGNLRNLEKLDIGDNKLVGIAPIAIFNVSTLKILGLQDNSLSGCLSSIGYA RLPNLEILSLWELSFLSSLSNCKELKYFDLSYNPLYRILPRTIVGNLSHSLEEFKMSNCNISGGIPEEISNLTNLRTIYL GGNKINGSILITLSKLQKLQDLGLKDNKLEGSIPYDICNLAELYRLDLDGNKLSGSIPACESNLTSLRIVSLGSNELTSI PLTFWNLKDILNENESSNELTGSLPLEIGSLKVLVGIDLSRNNESGVIPTEIGGLKNLEYLFLGYNRLQGSIPNSEGDLI SLKFLNLSNNNLSGVIPASLEKLSYLEDINLSFNQLEGKIPRGGSFGNESAQSFEGNELLCGSPNLQIPPCKTSIHHKSW KKSILLGIVLPLSTTFMIVASLGDGMEVAVKVFTSQCGRAFKSFDVECEIMKSIRHRNLIKVISSCSNEELNIMIDVASA LEYLHFGYSAPVIHCDLKPSNVLLDDNMVAHLSDFSIAKMLTGEDQSMIQTQTLATIGYMAPEYGREGRVSANGDVYSFG IMLMETFTGKKPTDEIFNGEMTLKHWEDIHFVAKEQCVSFVENLAMECTMEFPKQRINAKEIVTKLLKIRDSLLRNVGGR CVMKE |
| >GAY66431.1 hypothetical protein CUMW_248700, partial [*Citrus unshiu*] (SEQ ID NO: 330) TTANTITITIDQDALLALKAHITHDPTNFLAKNWNTSTPVCNWTGVTCDVHSHRVTVLNISRLNLTGTIPSQLGNLSSLQ SLNLSENREFGSIPSAIFTIYTLKYVSFRENQLSGTFPSLIENKSSLQHLDFTHNTLSGEIPANICSNLPFLEYESLFQN MFHGGIPSTLSNCTYLRILSLSSNDESGPIPKEIGNLTKLKELYLGRNRLHGEIPQEFGNLVKLELMSLPENKLQGEIPS EIGNEHNLEYLDLSLNKLVGVVPSAIENVSTLKYLGLQNNSLSGSLSSILDFRIENLEELHLWELSFLSSLSNCKSIRLI DLSNNSLDGILPRTSVGNLSHSLEYFDMSYCNVSGGIPEEINNLTNLITIYLAGNKLNGSIPITLSKLQKLQGLGLQDNK LKGLIPEDICRLAKLYELNLGGNMLSGSIPACESNLASLRTLSLGENELTSIPSTFWNLKDILYLNFSSNFFAGPLPLKI GNLKVLIEIDESMNNFSGVIPTTIGGLKNLQYLSIGNNRLQGSIPNSVGDLISLKSLNLSNNNLSGAIPVSLEKLTYLKD LDLSENKLEGEIPNGGSFGNESAESFEGNQLLCGLENLHVPPCKTSIHHTSWKNALLLGTFLPVSTIFMIVVIIEDGMDV AVKVENLEYGRAFKSFDVECEIMKSIRHRNLIKVISSCSNEELNIMIDVALALEYLHFGCSASVIHCDLKPSNVLLDDNM VAHLSDFGIAKLLTGEDQSMIQTQTLATIGYMAPEYGREGRVSANGDVYSFGIMLMETFTGKKPTDKIENGEMTLTHWED VHFAAKEQCMSFVENLAMECTAESPEQRINAKEIVTRLLKIKDSLLRNVGGLITLCNNSWGV |
| >GAY63066.1 hypothetical protein CUMW_222610, partial [*Citrus unshiu*] (SEQ ID NO: 331) MERVHSLSMISRELLLHCLVLIFLFIAAATANTSTITTDQDALLALKAHISHDPTNFLAKNWNKSTPICNWTGVTCDVHS HRVTVLNISSLNLTGTVPAQLGNLSSLQSLDLSENRLSGFIPSTIFTMYTLKRVSFRENQLSGTFPSFIENKSSLQHLDF SHNTLSGEIPANICSNLPFLEYISLSQNMFHGRIPPTLSNCTYLRILGLSLNNESGAIPKEISYLTKLKELYLGVNRLQG EIPREVGNLAELELMSLPENKLQGEIPQELGNLVGLEFLFLSDNFLIGTIPKEISNETNLQDLGLDSNRLQGEIPPEIGN LRSLEWLLLGYNKLVGTIPAAIFNVSTLKQLDLØNNSLSGSLSSIADVRLPNLEMIYMWELSFLSSLSNCKSLTHIRLSD NPLNGILPRTTVGNLSHSLELFDMSYCNISGSIPKEISNLTNLTTIYLVGNKLNGLIPITLGKLQKLQSLVLEDNKLKGS IPDDICRLAELYELNLGGNKLSGSIPACESNLASLRTLSLSSNELTSIPLTLWNLKDILYLNESSNFLSGPLPLEIENLK VLVGIDFSMNNFSSVIPTTIGSLKDLQYLLLAYNKLQGSIPDSVGDLISLKSLNLSNNNLSGAIPVSLEKVSYLENLDLS ENKLEGEIPKGGSFGNFSAESFEGNELLCGSPNLQVPPCKISIHHASRKNALLLGTALPLTRIQDGIEVAVKVENLQCGR AFKSFDVECQVMKSIRHRNLIKVISSCSNEELNIMIDVASALEYLHFGYSTPVIHCDLKPNNVLLDNNMVAHLSDFGIAK LLTGEDQFVTQTQTLATIGYMAPEYGREGRVSINGDVYSFGIMLMETFTGKKPTDKIENGEMTLKRWVVDANLLSREDIH FVAKEQCLSFVENLAMDCTVE |
| >GAY67254.1 hypothetical protein CUMW_255090, partial [*Citrus unshiu*] (SEQ ID NO: 332) ATANTSTITADQDALLSLKAHITHDPTNFLAKNWNTSISFCNWTGVTCDVHSHRVTILNISGLNLTGTIPSQLGNLSSLQ SINLSENQLSGSIPSAIFTTYTLTYVSLCQNQLSGKIPANICSNLPFLEFLSLSKNMLYGGIPSTLSNCTYLRILRAIPK EIGNLTKLKELSLGGNRLQGEIPREFGNLADLEQMSLWENNERGEIPLEIGNLQNLEELDLRQNKLVGIVPASIENVSTL KLLQLQNNSLLGCLSSIADVRLPNLEELSLWELVGNSFSGFIPNTFGNLRNLERLNLQDNYLTSSTPELSFLSSLSNCKS LTLIALSNNPLDGNLRKTSVGNLSHSLEIFLMYNCNISGGISEEISNETNLTTINLGGNKLNGSIPIALGKLQKLQYLGL EDNKLEGSIPDDICRLDELYELELGGNKLSGSIPACFGNLIALRILSLGSNELTSIPLTFWNIKDILQLNESSNYFTGPL PLEIGNLKVLIGIDESMNNFSGVIPTEIGGLKNLEYLELGYNRLRGSIPDSEGDLISLKFLNLSNNNLSGAIPASLEKLS YLEDINLSENKLEGEIPRGGSFGNFSAESFEGNELLCGSSNLQVPPCKTRIAHTSWKKSLLLGIVLPLSTTLMIVVIWLI LRYRQRGKQPSNDANMPLVATWRTFSYLELCQATDEFSENNLIGRGGFGSFISP |
| >ESR40316.1 hypothetical protein CICLE_v100269281mg, partial [*Citrus clementina*] (SEQ ID NO: 333) GNKLSGSLPACESNLTSLRIVSLGSNKLTSVPLTFWNIKDILNINFSSNFLTSPLPLEIGNLKVLIGIDESMNNFSGVIP TEIGGLKNLEYLELGYNRLQGSIPDSFGDLISLKELNLSNNNLSGAIPASLEKLSYLENLNLSENKLEGEIPRGGSEGNF SAESFEGNELLCGSPNLQVPPCKTSIHHTSWKNSLLLRIVLPLSTTFMIVVILLILRYQQRGKLKVFNLQCGRAFESFDV ECEMMKNIRHRNLIKVISSCSNEELNIMIDVASALEYLHFEYQSMTQTQTLATIGYMAPEYGREGRVSANGDVYSFGIML METFTGKKPTDEIFNGEMTLKHWVNDWLLISTMEVVDANLLSQEDIHFVAKEQCVSFVENLAMACTVESPEQRINAKEIV KKLLKIRDSLLRNVGGRFCE |
| >GAY68231.1 hypothetical protein CUMW_262510 [*Citrus unshiu*] (SEQ ID NO: 334) MCSNLYITNKALTVCSLPILHEWLFFCVREIPPEIGNLRNLEELDLGHNKLVGTVPAAIFNLSTLKEFSIPNNSLSGCLS SIADVRLPNLEVINEWGNNESGTIPRFIFNASKLSALDLDGNSFSGFIPNTFGNLRNLKWLILSDNYLTSSTPELSELSS LSNCKSLTYIDLSYNPLDSILPRTSVGNLSHSLEDFEMNNCNVSGGIPEEISNLTNLTTIDLGGNKLNGLIPITLSKLQK LQGLVLYDNKLEGSIPDDICRLAELYELELDGNKLSGSIPACLSNLISLRILSLGSNELTSIPLTFWNLEDILYLNESSN FLTGPLPLEIGKLKVLVGIDESMNNFSGVIPTKIGGLKNLEYLFLGYNRLQGSIPDSFGDLTSLKSLNLSNNNLSGTIPA SLEKLSYLENLNLSENKLEGEIPRGGSFGKFSAESFKGNELLCGSPNLQVPPCKTSIHHTSWKNSLLLGIVLPLSTTEMI VVILLILRYRQRGKQPSNDANMPLVENLECGRAFKSFDVECDMMKSIRHRNLIKVISSCSNEELNIMIDVASALEYLHFG YSAPVIHCDLKPSNVLLDDNMVAHLSDFSIAKLLTGEDQSMTQTQTLATIGYMAPEYGREGRVSANGDVYSEGIMLMETE TGKKPTDEIFNEEMTLKHWVNDWLPISTMEVVDVNLLSQEDIHFVAKEQCVSFVENLAMACTVESPEQRINAKEIVTKLL KIRDSLLRNVGGRFSLVLSRFIEVSSFLEGKGKCYLLLTDYEYENLTCETVLSAI |

TABLE 4-continued

| Polypeptide sequence of citrus plant positive defense regulators |
| --- |

>ESR63269.1 hypothetical protein CICLE_v10013944mg [*Citrus clementina*]
(SEQ ID NO: 335)
MYTLKYVNERGNQLSGAFPSFIENKSSLQDLDFSYNALSGEIPANICSNLPFLESISLSQNMFHGGIPSTLSNCKYLEIL
SLSINNLLGAIPKEIGNLTKLKELYLGYSGLQGEIPREFGNLAELELMALQVSNLQGEIPQELANLTGLEVLKLDKIFLT
GEIPPEIHNLHNLKLLDLSHNKLVGAVPATIFNMSTETGLGLQSNSLSGSLSSIADVQLPNLEELRLWSNNESGTIPRVI
FNASKLSVLELGINSFSGFIPNTFGNLRNLSELSSESNCKSLTYIGLSNNPLDGILPRMSMGNLSHSLEYFDLSYCNVSG
GFPEEIGNETNLIGIYLRGNKUNGSIPITLGKLQKLQGLHLEDNKLEGPIPDDICRLTKLYELGLSGNKLSGSIPACFSN
LASLGTLSLGSNKLTSIPLTIWNLKSMLYLNFSSNFFTGPLPLDIGNLKVLIGIDFSINNESDVIPTVIGGLINLQYLEL
GYNRLQGSISESEGDLISLKSLNLSNNNLSRSIPISLEKLSYLEDLDLSFNKLKGEIPKGGSFGNFSAKSFEGNELLCGS
PNLQVPPCKTSIHHKSRKNVLLLGIVLPLSTIFIIVVILLIVRYRKRVAVKVFDLQCGRAFKSFDVECEIMKSIRHRNLI
KVISSCSTEELNIMVDVATALEYLHEGYSAPVIHCDLKPNNVLLDDNMVAHLSDFGIAKLLIGEDQSMTQTQTLATIGYM
APDVYSEGIILMETEKGKKPTDEIFNEEMTLKHWVNDWLPISIMKVIDANLLSREDMHFVAKEQCVSFVENLAMECTVES
PQQRINAKKIVTRLLKIRDSLLRNVGATSLLYYRPNCFY >ESR40314.1 hypothetical protein CICLE_v10025188mg [*Citrus clementina*]
(SEQ ID NO: 336)
MNSFSGFIPSTEGNLRNLEWLTLYDNNLTSSTLDLSFLSSLSNCKSLTHISLSNNPLDGILPRTYVGNLSHSLKNFYMYN
CNVSGGIPEEITNLTDLTTIVIGGNKINGSIPITLGKLQKLQDVDLEYNQLEGSIPDSICLSVELYELELGGNKLSGSIP
ACESNMTFLKVLSLGSNELTSIPLNFWSLKDILDLNLSSNCFSGPLPLEIRNLKALIEIDESMNNESGIIPMEIGSLKNL
ENLFLEYNRLEGSIPDSFGDLISLKSLNLSYNNLSGTIPVSLEKLSYLKDLNLSENKLKGEIPRGGSFGNFSAESFKGNE
LLCGSPNLQVPPCKASIHRTSRKNALILGIVLPESTIFMTAIILFIIKYQKREKGPPNDPNMPPVENLQCGRAFKSEDVE
CAMMKSIRHRNLVKVISSCSNEELNIMIDVASALEYLHEGYSAPVIHCDLKPSNVLLDDNMVAHLSDFGIAKLLTGEDQS
MTQTQTLATIGYMAPEYGREGQVSTNGDVYSFGIMLMETFTRKKPTDELENGEMTLKHWVNDCLPISTMEVVDANLLSQE
DIHFVAKEQCVSFVENLALECTVESPEQRINAKEIVAKLLKIRDSLLRNVY >GAY63064.1 hypothetical protein CUMW_222610 [*Citrus unshiu*]
(SEQ ID NO: 337)
MERVHSLSMISRFLLLHCLVLIFLFIAAATANTSTITTDQDALLALKAHISHDPTNFLAKNWNKSTPICNWTGVTCDVHS
HRVTVLNISSINLTGTVPAQLGNLSSLQSLDLSENRLSGFIPSTIFTMYTLKRVSFRENQLSGTFPSFIENKSSLQHLDE
SHNTLSGEIPANICSNLPFLEYISLSQNMFHGRIPPTLSNCTYLRILGLSENNESGAIPKEISYLTKLKELYLGVNRLQG
EIPREVGNLAELELMSLPENKLQGEIPQELGNLVGLEFLELSDNFLTGTIPKEISNETNLQDLGLDSNRLQGEIPPEIGN
LRSLEWLLLGYNKLVGTIPAAIFNVSTLKQLDLQNNSLSGSLSSIADVRLPNLEMIYMWGNNESGTIPRFIFNASKLSIL
SLEKNSFSGFIPNTEGNLRNLEQLDLSDNYLTSSTPELSFLSSLSNCKSLTHIRLSDNPLNGILPRTTVGNLSHSLELED
MSYCNISGSIPKEISNLTNLTTIYLVGNKLNGLIPITLGKLQKLQSLVLEDNKLKGSIPDDICRLAELYELNLGGNKLSG
SIPACESNLASLRTLSLSSNELTSIPLTLWNLKDILYLNESSNELSGPLPLEIENLKVLVGIDFSMNNFSSVIPTTIGSL
KDLQYLLLAYNKLQGSIPDSVGDLISLKSINLSNNNLSGAIPVSLEKVSYLENLDLSENKLEGEIPKGGSEGNFSAESFE
GNELLCGSPNLQVPPCKISIHHASRKNALLLGTALPLSTIFMIVVILLILKCRKRRKRPSDDANIPPVENLQCGRAFKSF
DVECQVMKSIRHRNLIKVISSCSNEELNIMIDVASALEYLHFGYSTPVIHCDLKPNNVLLDNNMVAHLSDFGIAKLLTGE
DQFVTQTQTLATIGYMAPEYGREGRVSTNGDVYSFGIMLMETFTGKKPTDKIENGEMTLKRWICDWIPISIMEVVDANLL
SREDIHFVAKEQCLSFVENLAMDCTVECPEQRINAKEIVTRLLKIRDSLLRNVEGRCIRQSNLN >XP_024047981.1 probable LRR receptor-like serine/threonine-protein kinase At3g47570 [*Citrus clementina*]
(SEQ ID NO: 338)
MSTLTGLGLQSNSLSGSLSSIADVQLPNLEELREWSNNESGTIPRVIFNASKLSVLELGINSFSGFIPNTFGNLRNLRLL
TLHYNYLTSSNLELSFLSSFSNCKSLTYIGLSNNPLDGILPRMSMGNLSHSLEYFDLSYCNVSGGFPEEIGNLTNLIGIY
LRGNKLNGSIPITLGKLQKLQGLHLEDNKLEGPIPDDICRETKLYELGLSGNKLSGSIPACESNLASLGTLSLGSNKLTS
IPLTIWNLKSMLYLNFSSNFETGPLPLDIGNLKVLIGIDESTNNFSDVIPTVIGGETNLQYLELGYNRLQGSISESEGDL
ISLKSLNLSNNNLSRSIPISLEKLSYLEDLDLSFNKLKGEIPKGGSFGNFSAKSFEGNELLCGSPNLQVPPCKTSIHHKS
RKNVLLLGIVLPENRESENNLIGRGGFGSVYKARIGEGMEVAVKVEDLQCGRAFKSFDVECEIMKSIRHRNLIKVISSCS
TEEFKALVLEYMPHGSLEKNLYSSNCILDIFQRLNIMVDVATALEYLHFGYSAPVIHCDLKPNNVLLDDNMVAHLSDFGI
AKLLIGEDQSMTQTQTLATIGYMAPEYGRE >ESR40317.1 hypothetical protein CICLE_v10025171mg [*Citrus clementina*]
(SEQ ID NO: 339)
MSNCNVSGGIPEEISNLTHETTIILGGNKLNGSIPITLGKLQKLQGLGLGDNKLEGSIPDDICRLAELYRLELGGNKLYG
SIPTCFGNLASLRILSLGSNKLTSIPLTEWNLKDILQLNESSNFLTGPLPLEIGNLKVLIVIDESMNNFSGVISTEIGGL
KNLEYLFLGYNRLRGSIPDSFGDLISLKSINLSNNNLSGAIPTSLEKLSYLEDLNLSENKLEGEIPRGGSFANFSAESFE
GNELLCGSPNLQVPPCKTSIHHTSWKNSLLLGIVLPLSTTLLIVVIWLILRYRQRGKQPSNDANMSLVATWRKFSYLELC
RATDGFSENNLIGRGGFGSVYKARLGNGMEVAVKVENLQCGRAFKSFDVECEMMKSIRHRNLIKVISSCSNEEFKALVLE
YMPHGSLEKYLYSSNCILDIFQRLNIMIDVASALEYLHFGCSALVIHCDLKPSNVLLGDNMVAHLSDEGIAKLLIGEDQS
MTQTQTLGTIGYMAPEYGREGRVSANGDVYSFGIMLMETFTGKKPTDEIENGEMTLKHWVNELLPISTMEVVDANLLRQE
DIHFAAKEQCVSFIENLAMACTVESPEQRINAKEIVKKLLKIRDSLLRNVGGICIRQSNLN >XP_006465577.1 probable LRR receptor-like serine/threonine-protein kinase At3g47570 isoform X5 [*Citrus sinensis*]
(SEQ ID NO: 340)
MERLHSLRMMSRELLLHCLILISLFIAAATANTSSTITDRDALLALKAHITHDPINFLAKNWNTSTPVCNWTGVACDVHS
HRVTVLNISSLNLTGTIPSQLGNLSSLQSLNLSCNRLEGSIPSAIFTIYTLKYVSLRENQVSGQIPANICSNLPELDYLS
LGKNMFHGGIPSALSNCTYLQILHLSYNDFSGAVPKDIGNLSKLKELYLGRNRLQGEIPREFVNLTELERMSLSENELQG
GIPRELGNLTKLEGLQLFRNNLTGGIPRELGNLTKLERLQLFWNNLIGAIPKEIGNLTKLKELSLDGNRLQGEIPLEISN
LQNLEELDLRHNKLVGTVPAAIFNMSMLKLLHLQNNSLLGCLSSIADVRLPNLEALLLWDNPLDGILSKTSIGNLSHSLK
DFYMSNCNVSGGIPEEITNLINSITIDLGGNKLNGSIPITLSKLQKLQGLGLDDNKLEGSIPDSICRLTELYELELGGNK
LEGSIPACESNLASLRILSLSSNELTSIPLTFWNLKDILQLNESSNFLTGPLPLEIGNLKVLIGIDFSMNNESSVIPTEI
GGLKNLEYLFLGYNRLEGSIPDSFGDLISLKFLNLSNNNLSGAIPTSLEKLSYLEDLNLSENKLEGEIPRGGSFGNFAAE
SFEGNELLCGSPTLQVLPCKTSIHHTSWKNSLLLGIVLPLSTTLLIVVIWLILRYRKRGKQPSNDANMPLVATWRTFSYL TABLE 4-continued Polypeptide sequence of citrus plant positive defense regulators ELCRATNGFSENNLIGRGGFGSVYKARLGDGMEVAVKVENLQCGRAFKSFAVECEMMKSIRHRNLIKVISSCSNEEFKAL
VLEYKPHGSLEKYLYSSNCILDIFQRLNIMIDVASALEYLHEGCSAPVIHCDLKPDNVLLDDNLVAYLSDEGIAKLLIGE
DQSMTQTQTLATIGYMAPEYGREGRVSTNGDVYSFGIMLMETFTGKKPTDEIFNGEMTLKHWVNDWLPISTMEVVDANLL
SQEDVHEVAKEQCVSFVFNLAMACTVESHEQRINAKEIVTKLLKIRDSLLRNVGGRRISQPNLN >KDO36487.1 hypothetical protein CISIN_1g047705mg, partial [*Citrus sinensis*]

(SEQ ID NO: 341)

EIPLEIGNLQNLEELDLRQNKLIGTVPVAIFNVSTLKLLGLQDNSLSGSLSSITDVRLPNLEELVLWGNNFSELNELSSL
SNCKSLTVIGLSNNPLDGILPKTSIGNLSHSLEDFQMHNCNVTGDIPEEIGNLTNLITIDLGGNKLNGSILITLSKLQKL
QGLVLDDNKLEGSIPDDICREVELYKLELGGNKLSRSIPACENNLIALRILSLGSNDPLPLEIGNLKVLVGIDESMNNES
GIIPKEIGGLKNLEYLFLGYNRLQGLIPDSFGNLISLKFLNLSNNNLSGAIPASLEKLSYLEDLNLSFNKLEGEIPRGGS
FGNFSAESFEGNELLCGSPNLQVPPCKTSIHHPSWNISLLLGIVLPLSTTLMIVVIWLILRYRQRGKQPSNDANMPLVAM
WRTFSYLELCRATDGESENNLIGRGGFGSVYKARLGDGMEVAVKVENLQCRRAFKSFDVECEIMKSIRHRNLIKVISSCS
NEEFKGLVLEYMPQGSLEKHLYSTNCILDIFQRLNIMIDVASALEYLHFGCSTPVIHCDLKPSNVLLDDNMIAYLSDFGI
AKLLIGEDQSMTQTQTLATIGYMAP

>XP_024036868.1 probable LRR receptor-like serine/threonine-protein kinase At3g47570 [*Citrus clementina*]

(SEQ ID NO: 342)

MSRFLLLHCLILISLFIAAAAANTSSTITDRDGLLALKAHITHDPINFLAKNWNTSTPVCNWTGVACDVHSHRVTVLNIS
SLNLTGTIPSQLGNLSSLQSLNLSENRLSGSIPSAIFTMYTLKNVSFHENQLSGQIPANICSSLPFLEFFSLSKNMFHGG
IPSTLSNCTYLRILSLAYNDESGAVPREIGEIPREFCNLTELEQMSLAGGIPRELGNLTKLERLQLFENNLTGALPKEIG
NLTKLKHLSLDHNRLQGEIPREFGNLAELELLSLYENKLQGEIPLEIGNLQNLEELGLGQNKLIGTVPVAIFNVSTLKEL
ELQDNSLSGSLSSIVDVRLPNLEKLLLWGNNFSGTIPHFIFNASKLSILELSQNSFADFIPNTEGNLRNLQRLKLYDNYL
TSSTPELSELFSLSNCKSLTHLSLSNNPLDGILPRTSVGNLSHSLKEFYMSNCNVSGGIPEEITNLTNLTTIFFGGNKLN
GSIPITLGKLQKLQGLGLEDNKLEGSIPDNICRLTELYELELGGNKLSGSIPACENNLASLRILSLGSNELNSIPLTEWN
LKDILQINCSSNFFTGPLPSEIGNLKVLVGIDESMNNFSGVIPTEIGGLKNLEYLELGYNRLQGSIPNSEGDLISLKSEN
LSNNNLSGVIPASLEKLSYLEDLNLSENKLEGEIPTGGSFGNFSAESFEGNELLCGSPNLQVPPCKTSIHRTSWKNSLLL
GIVLPLSTTFMMVVILLILRYRQRGKRPSNDASMPLVAMWRTFSYLELCQATDEFSENNLIGKGGFGSVYKARLGDGMEV
AVKVENLQCGRALKSENVECEMMKSIRHRNLIKVISSCSNEEFKALVLEYMPHGSLEKYLYSSNCILDIFQRLNIMIDVA
SALEYLHFGYSAPIIHCDLKPSNVLLDDNMVAHLSDESIAKLLVGEDQSMTQTQTFATIGYMAPEYGREGRVSANGDVYS
FGIMLMETFTGKKPTDEIENGEMTLKHWVNDWLPISTLEVVDANLLSQEDIHFVAKEQCVSEVENLAMACAVESPEQRIN
AKEIVKKLLKIRDSLLRNVGGRCIRQSNLN

>GAY68466.1 hypothetical protein CUMW_264350 [*Citrus unshiu*]

(SEQ ID NO: 343)

MSRFLLVHYLILISLLIASATANISTITPDRDALLAMKAHITHDPTNFFAKNWNTSISFCNWTGVTCDVASHRVTVLNIS
RINLIGTIPSQLGNLSSLQSINLSENRLSGSIPSAIFTTYTLKYVSFRENQLSGAFPSFIYNKSSLQHLDFSENTLSGEI
PASICSNLPFLEYISLSKNMFHGGIPSALSKCTYLRILSLSYNDLSGAVPKDIGNLSKLKELYLGRNRLQGEIPRGEGNE
TELELMSLSENELQGGIPQELGNLTKLEMLQLEWNNLTGEIPLEIGNLQNLEELELGQNKLIGTVPVAIFNVSTLKFLEI
QNNSLSGSLSSIADVRLPNLEELLLWGNNFSGTIPRFIFNASKLSILDLQDNSFSSFIPNTEGNLRNLEWLNLQDNYLTS
STPELSFLSSLSNCKSLRLIGLSNNPLDGILPKTSVGNLSLSLEDFKMANCNISGGIPEEISNLINLITIDLGGNKINGS
ILITLSKLQKLQGLDLDDNKLEGSISDDICRLAELYELELDGNKLSGSIPACFSNLIALRILSLGSNELTSIPSTEWNLK
DILYLNFSSNFLTGPLPLEIGNLKVLVGIDFSMNNFSGVIPTEIGGLKNLEYLFLGYNRLQGSIPDSFGNLISLKFLNLS
NNNLSGAIPASLEKLSYLEDLNLSENKLEGEIPRGGSFGNFSAESFEGNELLCGSPNLQVPPCKTSIHHTSWKISLLLGI
VLPLSATLMIVVIWLILRYRQRGKQPSNDANMPLVATWRTFSYLELCRATNEFSENNLLGRGGFGSVYKARLGDGMEVAV
KVENLQCRRAFKSENVECEIMKSIRHRNLIKVISSCSNEEFKGLVLEYMPHGSLEKHLYSSNCILDIFQRLNIMIDVASA
LEYLHEGCSTPVIHCDLKPSNVLLDDNMVAYLSDFGIAKLLIGEDQSMTQTQTLATIGYMAPEYGREGRVSTNGDVYSFG
IMLMETFTGKKPTDEIENGEMTLKHWVNDWLPISTMEVVDANLLSQEDVHFVAKEQCVSFVENLAMACIVESHEQRINAK
EIVTKLLKIRDSLLRNVGGRRIRQPNLN

>XP_024958339.1 probable LRR receptor-like serine/threonine-protein kinase At3g47570 [*Citrus sinensis*]

(SEQ ID NO: 344)

MMSRFLLLHCLIIIFLFISAAAANTSSTITDREALLALKAHITHDPINFLAKNWNTSTPVCNWTGVTCDVHSHRVTVLNI
SSLNLTGTIPSQLGNLSSLQSLNLSENRLSGSIPSAIFTMYTLKNVTFRENQLSGQIPANICSSLPFLEFLSLSQNMFHG
GIPSTLSNCTYLRILSLSYNDFSGAVPREIGNSTKLKILYLGRNRLQGEIPREFCNLTELEHMSLAGNNLQGGIPQELGN
LAKLEMLQLFQNNLTGAIPKEIGNLTKLKELSLNANRLQGEIPREFGNLAELELMWLSENNLQGGIPRELGNLTKLEILH
LWKNNLTGAIPKEIGNLTKLKELPLYSNRLQGEIPREFGNLAELEMLSLYENKLQGEIPLEISNLQKLEDLGLGQNKLIG
IVPVAIFNVSTLKFLELQDNSLSGSLSSIVDVLPNLEKLLLWGNNFSGTIPHFIFNASKLSILELSQNSFAGFIPNTEGN
LRNLQRLKLYDNYLTSSTPELSFLFSLSNCKSLTHLSLSNNPLDGILQRTSVGNLSHSLKEFYMSNCNVSGGIPEEITNL
TNLTTIFFGGNKINGSIPITLGKLQKLQGLGLEDNKLEGSIPDNICRLTELYELELGGNKLSGSIPACENNLASLRILSL
GSNELTSIPLTEWNIKDILQLNCSSNFLTGQLPSEIGNLKVLVGIDESMNNFSGVIPTEIGGLKNLEYLFLGYNRLQGSI
PNSFGDLISLKSENLSNNNLSGAIPASLEKLSYLEDLNLSENKLEGEIPTGGSFGNFSAESFEGNELLCGSPNLQVSPCK
TSIHRTSWKKSLLLGIVLPLSTTEMIVVILLILRYRQRGKRPSNDASMPLVAMWRTFSYLELCRATDEFSENNLIGKGGF
GSVYKARLGDGMEVVVKVENLQCGRAFKSFDVECEMMKSIRHRNLIKVISSCSNEEFKALVLEYMPHGSLEKYLYSSNCI
LDIFQRENIMIDVASTLEYLYFGHSAPIIHCDLKPSNVLLDDNMVAHLSDFSIAKLLTGDDQSMTQTQTFATIGYMAPEY
GREGRVSANGDVYSFGIMLMETETGKKPTDEIFNEEMTLKQWVNDWLPISTMEVVDANLLSPEDVHFVAKEQCVSEVENL
AMACTVESPEQRINAKEIVTKLLKIRGSLLRNVGGRCIRQSNLN

>XP_015386042.1 probable LRR receptor-like serine/threonine-protein kinase At3g47570 [*Citrus sinensis*]

(SEQ ID NO: 345)

MEKRHSLSIMSRELLLRCLILISLFIAAATANTSTITTDRDALLALKAHITHDPTNFFAKNWNTSTPVCNWTGVTCDVHS
HRVTVLNISRLNITGTIPSQLGNLSSLQSLNLSCNRLSGSIPSAIFTTYTLKYVSERKNQLSGAFPSFAENTSSLQYLDE
GENTLSGEIPANICSNLPFLEYLALSQNMFHGGIPSALSNCAYLQRLGLSSNDFSGVVPKEICNETKLKGLYLGGNRLQG
EIPRESGNLAELELMSLSENELQGAIPREWGNLTGLGILQLSDNFLTGEIPLEIGNLQNLEELELGQNKLIGTVPVAIEN

TABLE 4-continued

| Polypeptide sequence of citrus plant positive defense regulators |
|---|
| VSTLRELDFQDNSLSGSLSSIADVRLLNLQELLLWGNKFSGTIPRFIFNASKLSILDLQDNSESSFIPNTEGNLRNLQRL RLYDNYLTSSTPELSFLSSLSNCKSLTHLSLSNNPLDGILQRTSVGNLSHSLKEFYMSNCNVSGGIPEEITNLTNLTTIY LGGNKLNGSIPITLGKLQKLQGLGLEDNKLQGSIPDNIFRETELYELELGGNKLSGSIPACENNLASLRILSLGSNELTS IPLTFWNLKDILQLNCSSNFLTGPLPSEIGNLKVLVIIDESMNNFSGVIPTEIGGLKNLEYLFLGYNRLQGSIPNSFGDL ISLKSLNLSNNNLSGAIPASLEKLSYLEDLNLSENKLEGEIPTGGSFGNFSAESFEGNELLYGTPNLQVPPCKTSIHRTS WKNSLLLRIVLPLSTTFMIVVILLILRYRQRGKRPSNDASMPLVAMWRTFSYLELCRATDEFSENNLIGTGGFGSVYKAR LGDGMEVAVKVENLQCGRAFKSEDVECEMMKSIRHRNLIKVISSCSNEEFKALVLEYMPHGSLEKYLYSSNCILDIFQRL NIMIDVASALEYLHFGYSAPIIHCDLKPNNVLLDDNMVAHLSDESIAKLLAGEDQSMTQTQTFATIGYMAPEYGREGRVS ANGDVYSFGIMLMETFTRKKPTDEIENGEMTLKHWVNDWLPISTMEVVDANLLSQEDIHFVAKEQCVSFVENLAMACTGE SPEQRINAKEIVKKLLKIRDSLLRNVGGRCIRQSNLN |
| >XP_006465575.1 probable LRR receptor-like serine/threonine-protein kinase At3g47570 isoform X3 [*Citrus sinensis*] (SEQ ID NO: 346) |
| MERLHSLRMMSRFLLLHCLILISLFIAAATANTSSTITDRDALLALKAHITHDPINFLAKNWNTSTPVCNWTGVACDVHS HRVTVENISSLNETGTIPSQLGNLSSLQSLNLSCNRLEGSIPSAIFTIYTLKYVSLRENQVSGQIPANICSNLPELDYLS LGKNMFHGGIPSALSNCTYLQILHLSYNDESGAVPKDIGNLSKLKELYLGRNRLQGEIPREFVNLTELERMSLSENELQG GIPRELGNLTKLEGLQLFRNNLIGGIPRELGNLTKLERLQLFWNNLTGAIPKEIGNLTKLKELSLDGNRLQGEIPLEISN LQNLEELDERHNKLVDVRLPNLEALLLWGNNFSGTIPRFIFNASKLSILELSQNSESGFIPNTEGNLRNLEWLNLRDNYL TSSTPELSFLSSLSNCKSLTFIHLSDNPLDGILSKTSIGNLSHSLKDFYMSNCNVSGGIPEEITNLINSITIDLGGNKLN GSIPITLSKLQKLQGLGLDDNKLEGSIPDSICRLTELYELELGGNKLEGSIPACFSNLASLRILSLSSNELTSIPLTEWN LKDILQLNESSNFLTGPLPLEIGNLKVLIGIDESMNNESSVIPTEIGGLKNLEYLFLGYNRLEGSIPDSFGDLISLKELN LSNNNLSGAIPTSLEKLSYLEDINLSENKLEGEIPRGGSFGNFAAESFEGNELLCGSPTLQVLPCKTSIHHTSWKNSLLD GIVLPLSTTLLIVVIWLILRYRKRGKQPSNDANMPLVATWRTESYLELCRATNGFSENNLIGRGGFGSVYKARLGDGMEV AVKVENLQCGRAFKSFAVECEMMKSIRHRNLIKVISSCSNEEFKALVLEYKPHGSLEKYLYSSNCILDIFQRLNIMIDVA SALEYLHFGCSAPVIHCDLKPDNVLLDDNLVAYLSDFGIAKLLIGEDQSMTQTQTLATIGYMAPEYGREGRVSTNGDVYS FGIMLMETFTGKKPTDEIFNGEMTLKHWVNDWLPISTMEVVDANLLSQEDVHFVAKEQCVSEVENLAMACTVESHEQRIN AKEIVTKLLKIRDSLLRNVGGRRISQPNLN |
| >GAY59873.1 hypothetical protein CUMW_197790 [*Citrus unshiu*] (SEQ ID NO: 347) |
| MERLHSLSIMSRFLLLNRLLLLISLFIAVATANTSTITTDRDALLAMKAHITHDPINFLAKNWNTSISFCNWTGVTCDVHG HRVTALNISGLNLISTIPFQLGNLSSLQSLNLSCNRLSGSIPSAIFTIYTLKYVSFRENQLSGAFPSFIENKSSLQHLDF SRNTLSGEIPANICSSLPFLEILSLSKNMFHGGIPSALSNCTYLQILSLSYNDESGAIPKDIGNLTKLKGLYLGRNSLQG EIPREFGNLSEMELMSLSENKLRGGIPQELGNLTKLEMLQLFLNNLTGAIPKEIGNLTKLKELSLERNMLQGEIPREFGN LSELELMSLSENELQGEIPREFGNLVELGLLSLYENKLQGAIPRELGNLTGLENLQLDENFLTGEIPLEIGNLQNLKELI LADNKLVGTVPTAIFNVSTLKLLALYNNSLSGCLSSIGDDQLPNLEILYLWGNNENGTIPRFIFNASKLSYLSLGENSFS GFIPNTEGNLRNLERLNFEDNYLTSSTPELSFLSSLSNCKSLTIIHLSNNPLDGILPKTSVSNLSLSFEEFYMYNCNISG GIPEEISNLTNLTTIKLGGNKLNGSIPIALGKLQKLQYLGLEDNKLEGSIPNDICRLAKLYLLELGGNKLYGSIPACEGN LASLRILSLGSNGLTSIPLTEWNLKDILYLNFSSNFFTGPLPLEIGNLKVLVGMDESMNNLSDVIPTEIGGLKNLEYLFL GYNKLQGSIPDSFGDLISLKELNLSNNNLSGAIPASLEKLSYLEDLNLSENKLEGEIPRGGSEGNESAESFEGNELLCGS PNLQVPPCKTRIHHASWKKSLLLGTILPLSTTEMIVVILLILRYRQRGKRPLNDANMPLVATWRMFSYLELCRATSGFSE NNLIGRGGFGSVYKARLGDGIEVAVKVENLQCERAFKSFDVECEVMKSIRHRNLIKVISSCSNEEFKALVLEYMPHGSLE KYLYSSNCILDIFQRLNIMIDVASALEYLHEGHSAPIIHCDLKPSNVLLDDNMVAHLSDFSIAKLLTGEDQSMTHTQTLA TIGYMAPEYGREGRVSANGDVYSFGIMLMETFTGKKPTDEMENEEMTLKHWVNDWLPISTMEVVDANLLSQEDIHEVAKE QCVSFVENLAMECTVESPEQRINAKEIVAKLLKIRDLLLRNVGGRCIRQSNLN |
| >XP_006465463.1 probable LRR receptor-like serine/threonine-protein kinase At3g47570 isoform X1 [*Citrus sinensis*] (SEQ ID NO: 348) |
| MERLHSLSIMSRERLLHCLILISLFIAAATANTSTITTDRDALLALKAHITHDPTNFFAKNWNTSISFCNWTGVTCDVHS HRVTVLNISRLNLTGTIPSQLGNLSSLQSENLSENRLSGSIPSAIFTMYTLKYVSFRENQLSGAFPSFIENKSSLQHLDF SQNTLSGEIPANICSNLPFLEYISLSKNMFHGGIPSALSKCTYLQILSLSENDESGAIPKDIGNLTKLMELYLGRNRLQG EIPREFGSLAELELMSLRESNLQGGIPQELGNLAKLEMLQLFQNNLTGAIPKEIGNLTKLEELYLGINRLQGEIPREFSN LAKLEMMSLSENNLQGEIPHELGNLSGLETLALYNNELTGEIPHEISNLQNLEELDLGHNKLVGTVPAAIFNVSTLKGES VSNNSLSGCLSSIVDARLPNLEVLYLWGNNFSGTIPRFIFNVSKLSKLSLEKNSESGFIPNTEGNLRNLKWLILYDNYLT SSTPGLSFLSSLSNCKSLTYIDLSHNPLDSILQRMSIGNLSHSLEEFQMYNCNVSGGIPEEIRNESNLTLIDLGGNKLNG SIPITLSKLQKLQGLGLENNKLEGSIPDDICRLAELFRLELGGNKLSGSIPTCFSNLASLRILSLGSNELTSIPLTFWNL KDILQLNFSSNELTGPLPLEIGNLKVLVGIDLSMNNESGVIPTEIGGLKNLEYLELGYNRLQGSIPNSEGDLINLKEINL SNNNLSGAIPASLEKLSYLEDINLSFNKLEGEIPRGGSFGNFSAESFEGNELLCGSPNLQVPPCKTGIHHTSSKNSLLLG IVLPLSTIFMIVVSLLILRYRQRGKRPSNDANMPLVATWRMVSYLELCRATDGESENNLIGKGGFGSVYKARLSDGMEVA VKVFNLQCGRAFKSFDIECEMMKSIRHRNLIKVISSCSNEEFKALVLEYMPHGSLEKYLYSSNCILDIFQRLNIMIDVAS ALEYLHFGHSAPIIHCDLKPSNVLLDDNMVAHLSDFSIAKLLIGEDQSMTHTQTLATIGYMAPEYGREGRVSTNGDVYSF GIMLMETFTEKKPTDEIFNEEMTLKQWVNDWLPISTMEVVDGNLLSQEDIHFVAKEQCVSYVENLAMACTVESPKQRINA KEIVTKLLKIRGSLLRNVGGRCIRQSNLN |
| >XP_006465464.1 probable LRR receptor-like serine/threonine-protein kinase At3g47570 isoform X2 [*Citrus sinensis*] (SEQ ID NO: 349) |
| MERLHSLSIMSRERLLACLILISLFIAAATANTSTITTDRDALLALKAHITHDPINFFAKNWNTSISFCNWTGVTCDVHS HRVTVLNISRLNLTGTIPSQLGNLSSLQSLNLSFNRLSGSIPSAIFTMYTLKYVSFRENQLSGAFPSFIENKSSLQHLDE SQNTLSGEIPANICSNLPFLEYISLSKNMFHGGIPSALSKCTYLQILSLSENDESGAIPKDIGEIPREFGSLAELELMSL RESNLQGGIPQELGNLAKLEMLQLFQNNLTGAIPKEIGNLTKLEELYLGINRLQGEIPREFSNLAKLEMMSLSENNLQGE IPHELGNLSGLETLALYNNFLTGEIPHEISNLQNLEELDLGHNKLVGTVPAAIFNVSTLKGFSVSNNSLSGCLSSIVDAR LPNLEVLYLWGNNFSGTIPRFIENVSKLSKLSLEKNSESGFIPNTFGNERNLKWLILYDNYLTSSTPGLSFLSSLSNCKS LTYIDISHNPLDSILQRMSIGNLSHSLEEFQMYNCNVSGGIPEEIRNLSNITLIDLGGNKLNGSIPITLSKLQKLQGLGL ENNKLEGSIPDDICRLAELFRLELGGNKLSGSIPTCESNLASLRILSLGSNELTSIPLTFWNLKDILQLNESSNFLTGPL |

TABLE 4-continued

| Polypeptide sequence of citrus plant positive defense regulators |
|---|
| PLEIGNLKVLVGIDLSMNNESGVIPTEIGGLKNLEYLFLGYNRLQGSIPNSEGDLINLKFLNLSNNNLSGAIPASLEKES YLEDLNLSENKLEGEIPRGGSFGNFSAESFEGNELLCGSPNLQVPPCKTGIHHTSSKNSLLLGIVEPLSTIFMIVVSLLI LRYRQRGKRPSNDANMPLVATWRMVSYLELCRATDGFSENNLIGKGGFGSVYKARLSDGMEVAVKVFNLQCGRAFKSFDI ECEMMKSIRHRNLIKVISSCSNEEFKALVLEYMPHGSLEKYLYSSNCILDIFQRLNIMIDVASALEYLHFGHSAPIIHCD LKPSNVLLDDNMVAHISDESIAKLLIGEDQSMTHTQTLATIGYMAPEYGREGRVSINGDVYSFGIMLMETFTEKKPTDEI FNEEMTLKQWVNDWLPISTMEVVDGNLLSQEDIHEVAKEQCVSYVENLAMACTVESPKQRINAKEIVTKLLKIRGSLLRN VGGRCIRQSNLN |
| >GAY68232.1 hypothetical protein CUMW_262510 [*Citrus unshiu*] (SEQ ID NO: 350) |
| MCSNLYITNKALTVCSLPILHEWLFFCVREIPPEIGNERNLEELDLGANKLVGTVPAAIFNLSTLKEFSIPNNSLSGCLS SIADVRLPNLEVINEWGNNESGTIPRFIFNASKLSALDLDGNSFSGFIPNTEGNLRNLKWLILSDNYLTSSTPELSELSS LSNCKSLTYIDLSYNPLDSILPRTSVGNLSHSLEDFEMNNCNVSGGIPEEISNLTNLTTIDIGGNKLNGLIPITLSKLQK LQGLVLYDNKLEGSIPDDICRLAELYELELDGNKLSGSIPACLSNLISLRILSLGSNELTSIPLTEWNLEDILYLNFSSN FLTGPLPLEIGKLKVLVGIDFSMNNFSGVIPTKIGGLKNLEYLFLGYNRLQGSIPDSFGDLTSLKSLNLSNNNLSGTIPA SLEKLSYLENLNLSENKLEGEIPRGGSFGKFSAESFKGNELLCGSPNLQVPPCKTSIHHTSWKNSLLLGIVEPLSTTEMI VVILLILRYRQRGKQPSNDANMPLVAMWRMFPYLELCRATDGFSENNLIGKGGFGSVYKARLGDGMEVAVKVENLECGRA FKSFDVECDMMKSIRHRNLIKVISSCSNEEFKALVLEYMPHGSLEKYLYSSNCILDIFQRLNIMIDVASALEYLHEGYSA PVIHCDLKPSNVLLDDNMVAHLSDFSIAKLLTGEDQSMTQTQTLATIGYMAPEYGREGRVSANGDVYSFGIMLMETFTGK KPTDEIFNEEMTLKHWVNDWLPISTMEVVDVNLLSQEDIHFVAKEQCVSEVENLAMACTVESPEQRINAKEIVTKLLKIR DSYGCFLNLESE |
| >GAY69164.1 hypothetical protein CUMW_269900 [*Citrus unshiu*] (SEQ ID NO: 351) |
| MMSRFLLLHCLILISLFIAAATANTSSTITDRDALLALKAHITHDPINFLAKNWNTSTPVCNWTGVACDVHSHRVTVLNI SSLNLIGTIPSQLGNLSSLQSLNLSCNRLSGSIPYTIFTTYTLKAVSLGENQLSGQIPTNICSNLPFLEILFLSENMEHG EIPSALSNCTYLRILSLAYNDESGAVPREIGNLTKLRELYLGRNRLQGGIPQELGNLAKLEGLQLLQNNLTGEIPLEISN LKNLEELQLGQNKLIGTVPVAIFNVSTLKFLGLQNNSLSGSLSSIANVRLPNLEKLYLWGNNESGTIPRFIFNASKLSKL SLGMNSFSGFIPSTEGNLRNLEQLGLDENYLTSSTPELSFLSSLSNCKSLTLIALSNNPLDGILPKTSISNLSRSLEEFY MYNCNISGSIPEEISNLTNLVEIDLGGNKINGSIPITLGKLRKLQRLNLEDNILEGSIPDDICRLAELYRLELGSNKLYG SIPACEGNLASLRILSLGSNKLTSIPLTFWNLKDILQLNESSNFLTGPLLLEIGNLKVLIGIDESMNNFSGVIPREIGGL KNLEYLFLGYNRERGSIPDSEGDLISLKFLNLSNNNLSGAIPTSLEKLSYLEDLNLSENKLEGEIPRGGSEGNFSAESFE GNELLCGSPNLQVPPCKTSIHHTSWKNSLLLGIVEPLSTTLLIVVIWLILRYRQRGKKPSNDANMPLVATWRTFSYLELC RATDEFSENNLIGRGGFGSVYKARLGDGMEVAVKVENLQCGRAFKSFDVECEMMKSIRHRNLIKVISSCSNEEFKALVLE YMPNGSLEKYLYSSNCILDIFQRLNIMIDVASALEYLHEGYSALVIHCDLKPSNVLLDDNMVAHLSDFSIAKLLTGEDQS MTQTQTLGTIGYMAPEYGREGRVSINGDVYSFGIMLMETFAGKKPTDEIFNEEMTLKQWVNGWLPISTVEVVDPNLLSQE DVHFVAKEQCVSEVENLAMACTVESPEKRINAKEIVTKLLKIRGSLLRNVGGRCIRQSNLN |
| >XP_024954373.1 probable LRR receptor-like serine/threonine-protein kinase At3g47570 isoform X3 [*Citrus sinensis*] (SEQ ID NO: 352) |
| MERLHSLSIMSRERLLACLILISLFIAAATANTSTITTDRDALLALKAHITHDPTNFFAKNWNTSISFCNWTGVTCDVHS HRVTVLNISRLNETGTIPSQLGNLSSLQSLNLSENRLSGSIPSAIFTMYTLKYVSFRENQLSGAFPSFIENKSSLQHLDE SQNTLSGEIPANICSNLPFLEYISLSKNMFHGGIPSALSKCTYLQILSLSENDESGAIPKDIGNITKLMELYLGRNRLQG EIPREFGSLAELELMSLRESNLQGGIPQELGNLAKLEMLQLFQNNLTGAIPKEIGNLTKLEELYLGINRLQGEIPREFSN LAKLEMMSLSENNLQGEIPHEISNLQNLEELDLGHNKLVGTVPAAIFNVSTLKGFSVSNNSLSGCLSSIVDARLPNLEVL YLWGNNESGTIPRFIFNVSKLSKLSLEKNSESGFIPNTEGNERNLKWLILYDNYLTSSTPGLSFLSSLSNCKSLTYIDES HNPLDSILQRMSIGNLSHSLEEFQMYNCNVSGGIPEEIRNISNLTLIDLGGNKLNGSIPITISKLQKLQGLGLENNKLEG SIPDDICRLAELFRLELGGNKLSGSIPTCFSNLASLRILSLGSNELTSIPLTFWNLKDILQLNESSNFLTGPLPLEIGNL KVLVGIDLSMNNFSGVIPTEIGGLKNLEYLFLGYNRLQGSIPNSFGDLINLKFLNLSNNNLSGAIPASLEKLSYLEDINL SENKLEGEIPRGGSFGNFSAESFEGNELLCGSPNLQVPPCKTGIHHTSSKNSLLLGIVLPLSTIFMIVVSLLILRYRQRG KRPSNDANMPLVATWRMVSYLELCRATDGESENNLIGKGGFGSVYKARLSDGMEVAVKVENLQCGRAFKSEDIECEMMKS IRHRNLIKVISSCSNEEFKALVLEYMPHGSLEKYLYSSNCILDIFQRLNIMIDVASALEYLHFGHSAPIIHCDLKPSNVL LDDNMVAHLSDFSIAKLLIGEDQSMTHTQTLATIGYMAPEYGREGRVSTNGDVYSFGIMLMETFTEKKPTDEIFNEEMTL KQWVNDWLPISTMEVVDGNLLSQEDIHFVAKEQCVSYVFNLAMACTVESPKQRINAKEIVTKLLKIRGSLLRNVGGRCIR QSNLN |
| >XP_024953035.1 probable LRR receptor-like serine/threonine-protein kinase At3g47570 isoform X2 [*Citrus sinensis*] (SEQ ID NO: 353) |
| MERLHSLRMMSRFLLLHCLILISLFIAAATANTSSTITDRDALLALKAHITHDPTNFLAKNWNTSTPVCNWTGVACDVHS HRVTVLNISSLNETGTIPSQLGNLSSLQSLNLSCNRLFGSIPSAIFTIYTLKYVSLRENQVSGQIPANICSNLPFLDYLS LGKNMEHGGIPSALSNCTYLQILHLSYNDESGAVPKDIGNLSKLKELYLGRNRLQGEIPREFVNETELERMSLSENELQG GIPRELGNITKLERLQLFWNNLTGAIPKEIGNLTKLKELSLDGNRLQGEIPLEISNLQNLEELDERHNKLVGTVPAAIEN MSMLKLLHLQNNSLLGCLSSIADVRLPNLEALLEWGNNESGTIPRFIFNASKLSILELSQNSFSGFIPNTEGNLRNLEWL NERDNYLTSSTPELSFLSSLSNCKSLTFIHLSDNPLDGILSKTSIGNESHSLKDEYMSNCNVSGGIPEEITNLINSITID LGGNKLNGSIPITLSKLQKLQGLGLDDNKLEGSIPDSICRLTELYELELGGNKLFGSIPACFSNLASLRILSLSSNELTS IPLTEWNLKDILQLNESSNFLTGPLPLEIGNLKVLIGIDESMNNESSVIPTEIGGLKNLEYLFLGYNRLEGSIPDSFGDL ISLKFINLSNNNLSGAIPTSLEKLSYLEDENLSENKLEGEIPRGGSFGNFAAESFEGNELLCGSPTLQVLPCKTSIHHTS WKNSLLLGIVLPLSTTLLIVVIWLILRYRKRGKQPSNDANMPLVATWRTFSYLELCRATNGFSENNLIGRGGEGSVYKAR LGDGMEVAVKVENLQCGRAFKSFAVECEMMKSIRHRNLIKVISSCSNEEFKALVLEYKPHGSLEKYLYSSNCILDIFQRL NIMIDVASALEYLHFGCSAPVIHCDLKPDNVLLDDNLVAYLSDFGIAKLLIGEDQSMTQTQTLATIGYMAPEYGREGRVS INGDVYSFGIMLMETFTGKKPTDEIFNGEMTLKHWVNDWLPISTMEVVDANLLSQEDVHFVAKEQCVSFVENLAMACTVE SHEQRINAKEIVTKLLKIRDSLLRNVGGRRISQPNLN |

TABLE 4-continued

| Polypeptide sequence of citrus plant positive defense regulators |
|---|
| >XP_006465573.1 LRR receptor-like serine/threonine-protein kinase EFR isoform X1 [*Citrus sinensis*]<br>(SEQ ID NO: 354)<br>MERLHSLRMMSRFLLLHCLILISLFIAAATANTSSTITDRDALLALKAHITHDPTNFLAKNWNTSTPVCNWTGVACDVHS<br>HRVTVLNISSLNLTGTIPSQLGNLSSLQSLNLSCNRLFGSIPSAIFTIYTLKYVSLRENQVSGQIPANICSNLPFLDYLS<br>LGKNMFHGGIPSALSNCTYLQILHLSYNDESGAVPKDIGNLSKLKELYLGRNRLQGEIPREFVNLTELERMSLSENELQG<br>GIPRELGNLTKLEGLQLFRNNLTGGIPRELGNLTKLERLQLEWNNLTGAIPKEIGNLTKLKELSLDGNRLQGEIPLEISN<br>LQNLEELDERHNKLVGTVPAAIFNMSMLKLLHLQNNSLLGCLSSIADVRLPNLEALLEWGNNESGTIPRFIFNASKLSIL<br>ELSQNSFSGFIPNTFGNLRNLEWLNLRDNYLTSSTPELSFLSSLSNCKSLTFIHLSDNPLDGILSKTSIGNLSHSLKDFY<br>MSNCNVSGGIPEEITNLINSITIDIGGNKLNGSIPITLSKLQKLQGLGLDDNKLEGSIPDSICRLTELYELELGGNKLFG<br>SIPACESNLASLRILSLSSNELTSIPLTFWNLKDILQLNESSNELTGPLPLEIGNLKVLIGIDESMNNESSVIPTEIGGL<br>KNLEYLELGYNRLEGSIPDSEGDLISLKFLNLSNNNLSGAIPTSLEKLSYLEDINLSENKLEGEIPRGGSFGNFAAESFE<br>GNELLCGSPTLQVLPCKTSIHHTSWKNSLLLGIVLPLSTTLLIVVIWLILRYRKRGKQPSNDANMPLVATWRTFSYLELC<br>RATNGFSENNLIGRGGFGSVYKARLGDGMEVAVKVENLQCGRAFKSFAVECEMMKSIRHRNLIKVISSCSNEEFKALVLE<br>YKPHGSLEKYLYSSNCILDIFQRLNIMIDVASALEYLAFGCSAPVIHCDLKPDNVLLDDNLVAYLSDEGIAKLLIGEDQS<br>MTQTQTLATIGYMAPEYGREGRVSTNGDVYSFGIMLMETFTGKKPTDEIENGEMTLKHWVNDWLPISTMEVVDANLLSQE<br>DVHFVAKEQCVSEVENLAMACTVESHEQRINAKEIVTKLLKIRDSLLRNVGGRRISQPNLN<br><br>>XP_024952125.1 probable LRR receptor-like serine/threonine-protein kinase At3g47570 [*Citrus sinensis*]<br>(SEQ ID NO: 355)<br>MERVHSFRMMSRFLLLHCLILISLFIAAATANTSSTITDRDALLALKARITHDPINFLAQNWNTSTPVCNWTGVACDVHS<br>HRVTVLNISSLNETGTIPSQLGNLSSLQSLNLSENRLSSSIPSAIFTIYTLQNVSERKNQLTGTFPSFIENKSSLQHLDE<br>SENTLSGEIPANICSNEPFLEYLALSNNMFHGGILSALSNCTYLQKLDLVYNDFSGAVPREIGNLTKLKELHLGRNRFQG<br>EIPREFGNLAELEQMSLAENNLQGGIPQELGNLAKLKTLQLFQNNLTGEIPPEIGNLRNLEELDLGHNKLVGTVPAAIEN<br>LSTLKEESIPNNSLSGCLSSIADVRLPNLEVINEWGNNFSGTIPRFIFNASKLSALDLDGNSESGFIPNTEGNLRNLKWL<br>ILSDNYLTSSTPELSELSSLSNCKSLTYIDESYNPLDSILPRTSVGNLSHSLEDFEMNNCNVSGGIPEEISNLTNLTTID<br>LGGNKINGLIPITLSKLQKLQGLVLYDNKLEGSIPDDICRLAELYELELDGNKLSGSIPACLSNLISLRILSLGSNELTS<br>IPLIFWNLEDILYLNFSSNELTGPLPLEIGKLKVLVGIDFSMNNESGVIPTKIGGLKNLEYLFLGYNRLQGSIPDSEGDL<br>TSLKSLNLSNNNLSGTIPASLEKLSYLENINLSENKLEGEIPRGGSFGKFSAESFKGNELLCGSPNLQVPPCKTSIHHTS<br>WKNSLLLGIVEPLSTTFMIVVILLILRYRQRGKQPSNDANMPLVATWRMFPYLELCRATDGFSENNLIGKGGFGSVYKAR<br>LGDGMEVAVKVENLECGRAFKSFDVECDMMKSIRHRNLIKVISSCSNEEFKALVLEYMPHGSLEKYLYSSNCILDIFQRD<br>NIMIDVASALEYLHFGYSAPVIHCDLKPSNVLLDDNMVAHLSDFSIAKLLTGEDQSMTQTQTLATIGYMAPEYGREGRVS<br>ANGDVYSEGIMLMETFTGKKPTDEIFNEEMTLKHWVNDWLPISTMEVVDVNLLSQEDIHFVAKEQCVSEVENLAMACTVE<br>SPEQRINAKEIVTKLLKIRDSLLRNVGGRCIRQSNLN<br><br>>XP_006465462.1 receptor kinase-like protein Xa21 [*Citrus sinensis*]<br>(SEQ ID NO: 356)<br>MMSRFLLLHCLILISFFIAAATANTSSTITDRDALLALKARITHDPINFLAKNWNTSTHVCNWTGVACDVHSHRVTVLNI<br>SSLNLTGIIPSQLGNLSSLQSLNLSCNRLSGSIPSAIFTIYTLKYVSFRENQLSGAFSSFIENKSSLQHLDFSHNTLSGE<br>IPANICSSLPFLDFLSLQENMLHGGIPSTLSNCTYLQKLGLVYNNESGAIPKEIGNLTKLKILYLGGNRLQGEIPREFGN<br>LADLERMSLSENNLQGGIPRELGNLTKLEILQLERNNLTGAIPRELGNITGLGVLELSENFLTGEIPLEIGNLQNLEELE<br>LGHNKLIGTVPVAIFNVSTTLKLLGLQDNSLSGGLSSIANVRLPNLEELYLWGNNESGTIPRFIFNASKLSILDLDKNSF<br>SGFIPNTFGNLRNLEYLDLQYNYLTSETLELSFLSSLSNCKSLTLIGLSNNPLDGILPRTSVGNLSHSLKYFKMHNCNIS<br>GGIPEEISNLTNLMTIDLGGNKLNGSIPITLGKLQKLQWLSLDDNKLEGSIPDDICRLAELYLLELGGNKLYGLIPACFG<br>NLASLRILSLCSNELTSIPLTFWNLKDILHLYFSLNFFTGPLPLEIGNLKVLIGIDESMNNFSGVIPTEIGGLKNLESLE<br>LGYNRLRGSIPDSFGDLISLKFLNLSNNNLSGAIPTSLEKLSYLEDINLSENKLEGEIPRGGSEGNFLAESFEGNELLCG<br>SENDQVPPCKTSIHHTSWKKSLLLGTILPLSTTFMIVVIWLILRYRQRGKRPSNDANMPLVATWRMFSYLELCRATSGES<br>ENNLIGRGGFGSVYKARLGDGMEVAVKVENLQCERAFKSFDVECEVMKSIRHRNLIKVISSCSNEEFKALVLEYMPHGSL<br>EKYLYSSNCILDIFQRLNIMIDVASALEYLHFGCSTPVIHCDLKPNNVLLDDNMVAYLSDFGIAKLLIGEDQSMTQTQTL<br>ATIGYMAPEYGREGRVSTNGDVYSFGIMLMETFTGKKPTDEIENGEMTLKHWVNDWLPISTMEVVDANLLSQEDVHFVAK<br>EQCVSEVENLAMACTVESHEQRINAKEIVTKLLKIRDSLLRNVGGRRIRQPNLN<br><br>>XP_024957148.1 probable LRR receptor-like serine/threonine-protein kinase At3g47570 [*Citrus sinensis*]<br>(SEQ ID NO: 357)<br>MERVHSLRMMSIFLLLHCLIIISLFIAATTANTSSNITDRDALLALKAHITHDPINFLAKNWNTSTPVCNWTGVACDIHS<br>HRVTVENISSLNERGTIPSQLGNLSSLQSLNLSCNRLSGSIPSAIFTIYTLKNVSLGKNQLSGQIPTNICSNLPFLEFLS<br>LSLNMFHGGIPSTLSNCTYLRILSLAYNDFSGAVPREIGNLTKLKVLYIGANRLQGEIPREFGNLTELEQFSLPINNLQG<br>GIPQELGNLAKLEILQLFQNNLIGPIPRELGNITGLGILALSDNELTGEIPTEISNLRNLEELDLARNKLVGIVPAAIEN<br>VSTLQHLGLQDNSLLGCLSSNGDVRLPNLEGLYLSGNNFSGTIPRFIFNASKLFKLSLQRNSLFGFIPNTEGNLRNLKWL<br>SLYDNYLTSSTPELSFLSSLSNSKSLTFIDLSNNPLDSVLPKTFVGNVSHSLEFFVMSYCNISGVIPEEITNLTKLTTII<br>LGGNKINGSIPITLSKLQKLQYLGLDDNKLEGSIPDSICRLAELYDLELGGNKLSGSIPACFSNLASLRTLSLDSNELTY<br>IPLTFWNLKDILYLNFSSNFLIGPLPLEVGNLKVLVGIDESMNNFSGVIPTEIGGLQNLEYLFLGYNRLQGSIPDSEGDL<br>ISLKSLNLSNNNLSGAIPASLEKLLYLEDINLSENKLEGEIPRGGSFGNFSAESFEGNELLCGSPNLQVPPCKTSIAPTS<br>SKNSLLLGIVEPLSTTFMIVVILLILRYRQRGKRPSNDANIPLVATWRMFSYLELCQATDEFSENNLIGKGGFGSVYKAR<br>LGDGMEVAVKVFNLQCGRAFKSFDIECEMMKSIRHRNLIKVISSCSNEEFKALVLEYMPHGSLEKYLYSSNCILDIFQRL<br>NIMIDVASTLEYLYFGHSAPIIHCDLKPSNVLLDDNMVAHLSDESIAKLLTGDDQSMTQTQTFATIGYMAPEYGREGRVS<br>ANGDVYSFGIMLMETFTGKKPTDEIFNEEMTLKQWVNDWLPISTMEVVDANLLSPEDVHFVAKEQCVSEVENLAMACTVE<br>SPEQRINAKEIVTKLLKIRGSLLRNVGGRCIRQSNLN<br><br>>KDO39003.1 hypothetical protein CISIN_1g046544mg, partial [*Citrus sinensis*]<br>(SEQ ID NO: 358)<br>EIPLEISNLQNLEELDLRHNKLVGTVPAAIFNMSMLKLLHLQNNSLLGCLSSIADVRLPNLEALLLWGNNESGTIPRFIF<br>NASKLSILELSQNSFSGFIPNTFGNLRNLEWINLRDNYLTSSTPELSFLSSLSNCKSLTFIHLSDNPLDGILSKTSIGNL<br>SHSLKDFYMSNCNVSGGIPEEITNLINSITIDLGGNKLNGSIPITLSKLQKLQGLGLDDNKLEGSIPDSICRLTELYELE<br>LGGNKLEGSIPACFSNLASERILSLSSNELTSIPLTFWNLKDILQLNESSNFLTGPLPLEIGNLKVLIGIDESMNNESSV |

TABLE 4-continued

Polypeptide sequence of citrus plant positive defense regulators

IPTEIGGLKNLEYLFLGYNRLEGSIPDSEGDLISLKFLNLSNNNLSGAIPTSLEKLSYLEDLNLSENKLEGEIPRGGSFG
NFAAESFEGNELLCGSPTLQVLPCKTSIHHTSWKNSLLLGIVLPLSTTLLIVVIWLILRYRKRGKQPSNDANMPLVATWR
TESYLELCRATNGFSENNLIGRGGFGSVYKARLGDGMEVAVKVENLQCGRAFKSFAVECEMMKSIRHRNLIKVISSCSNE
EFKALVLEYKPHGSLEKYLYSSNCILDIFQRLNIMIDVASALEYLHFGCLAPVIHCDLKPDNVLLDDNLVAYLSDEGIAK
LLIGED

>XP_024041864.1 probable LRR receptor-like serine/threonine-protein kinase At3g47570 [*Citrus clementina*]

(SEQ ID NO: 359)

MCSNLYGINKALTVCSLSILHEWLFLCVSTGEIPTEISNLRNLEELDLARNKLVGIVPAAIFNVSTLQHLGLQDNSLFGC
LSSIGDVRLPNLEGLYLSGNNESGTIPRFIFNASKLFKLSLQRNSFFGFIPNTFGNLRNLKWLSLYDNYLTSSTPELSFL
SSLSNSKSLTFIDLSNNPLDSVLPKTFVGNVSHSLEFFVMSYCNISGSIPEEITNLTKLTTIILGGNKLNGSIPITLSKL
QKLQYLGLDDNKLEGSIPDSVCRLAELYDLELGGNKLFGSIPACESNLASLRTLSLDSNELTSIPLTEWNLKDILYLNES
SNFLIGPLPLEVGNLKVLVGIDESMNNESGVIPTEIGGLQNLEYLFLGYNRLQGSIPDSFGDLISLKSINLSNNNLSGAI
PASLEKLLYLEDENLSENKLEGEIPRGGSEGNFSAESFEGNELLCGSPNLQVPPCKTGIHHTSSKNSLLLGIVLPLSTIE
MIVVILLILRYRQRGKRPSNDANMPLVATWRMFSYLELCRATDGFSENNLIGKGGFGSVYKARLGDGMEIAVKVENLQCG
RAFKSFDIECEMMKSIRHRNLIKVISSCSNEEFKALVLEYMPHGSLEKYLYSSNCILDIFQRLNIMIDVASALEYLHFGH
SAPIIHCDLKPSNVLLDDNMVGHLSDFSIAKLLTGEDQSMTHTQTLATIGYMAPEYGREGRVSANGDVYSFGIMLMETFT
RKKPTDEMENGEMTLKHWVNDWLPISTMEVVDANLLSQEDIHEVAKEQCVSFVENLAMECTVESPKQRINAKEIVAKLLK
IRDSLERNVGGRCIRQSNLN

>ESR49610.1 hypothetical protein CICLE_v10033353mg, partial [*Citrus clementina*]

(SEQ ID NO: 360)

MCSNLYGTNKALTVCSLSILHEWLFLCVSTGNNCVIPTEISNLRNLEELDLARNKLVGIVPAAIFNVSTLQHLGLQDNSL
FGCLSSIGDVRLPNLEGLYLSGNNFSGTIPRFIFNASKLFKLSLQRNSFFGFIPNTFGNLRNLKWLSLYDNYLTSSTPEL
SELSSLSNSKSLTFIDLSNNPLDSVLPKTFVGNVSHSLEFFVMSYCNISGSIPEEITNLTKLTTIILGGNKLNGSIPITL
SKLQKLQYLGLDDNKLEGSIPDSVCRLAELYDLELGGNKLFGSIPACFSNLASLRTLSLDSNELTSIPLTEWNLKDILYL
NFSSNFLIGPLPLEVGNLKVLVGIDESMNNESGVIPTEIGGLQNLEYLELGYNRLQGSIPDSFGDLISLKSENLSNNNLS
GAIPASLEKLLYLEDINLSENKLEGEIPRGGSFGNFSAESFEGNELLCGSPNLQVPPCKTGIHHTSSKNSLLLGIVLPLS
TIFMIVVILLILRYRQRGKRPSNDANMPLVATWRMFSYLELCRATDGFSENNLIGKGGFGSVYKARLGDGMEIAVKVFNL
QCGRAFKSEDIECEMMKSIRHRNLIKVISSCSNEEFKALVLEYMPHGSLEKYLYSSNCILDIFQRLNIMIDVASALEYLH
FGHSAPIIHCDLKPSNVLLDDNMVGHLSDESIAKLLTGEDQSMTHTQTLATIGYMAPEYGREGRVSANGDVYSFGIMLME
TFTRKKPTDEMENGEMTLKHWVNDWLPISTMEVVDANLLSQEDIHFVAKEQCVSFVENLAMECTVESPKQRINAKEIVAK
LLKIRDSLLRN

>XP_006465518.1 probable LRR receptor-like serine/threonine-protein kinase At3g47570 [*Citrus sinensis*]

(SEQ ID NO: 361)

MMSRFLLLHCLILISLFIAAATANTSSTITDRDALLALKAHITHDPINFLAKNWNTSTPVCNWTGVTCDVHSHRVTVLNI
SSLNLTGTIPSQLGNLSSLKSLNLSENRLSGSIPSTIFTTFTLTYVSLRQNQLSGQIAANICSNLPFLEVLSLSRNMFQG
GIPSTLSNCTYLQTLALSYNNESGTIPIEIGNLTKLKELYLGVNRLQGEIPREFGNLADLEQMSLAINNLQGGIPRELGN
LTKLEMLQLFENNLTGAIPKEIGNLTKLKELSLFGNRLQGAIPRELGNITRLGILALPNNFLTGEIPLEIGNLQNLEELD
LGLNKLIGTVPATIFNVSTLKLLLLEHNSLLGSLSSIANVRLPNLEELLLWGNNFSGTIPRFIFNASKLSILELSKNSES
GFIPNTEGNLRNINWLYLNDNNLASSTPELSFLSSLSNCKSLTHIALSHNPLDGILPRTSVGNLSHSLKEFYMSNCNVSG
GIPEEITNLTNLTTIYLGGNKLNGSIPITLSKLQKLQGLGLEDNKLEGSIPDSICHLTELYDLKLGGNKLFGSIPACENN
LDSLRILSLGSNELTSIPLTEWNLKDILYLNFSSNFFTDPLPLEIGNLKVLIGIDFSMNNFSGVIPTEIGGLKDLEYLFL
GYNRLQGSIPDSEGNLISLKELNLSNNNLSGAIPASLEKLSYLEDLNLSENKLEGEIPRGGSFGNFSAESFEGNELLCDS
PNLQVPPCKTSIHHTSWKISLLLGIVEPLSTTFMIVVILLILRYRQRGKQPSNDANMPLVATWRTFSYLELCRATDGFSE
NNLIGKGGFGSVYKARLGDGMEVAVKVENLQCRRAFKSFDVECEMMKSIRHRNLIKVISSCSNEEFKGLVLEYMPQGSLE
KHLYSSNCILDIFQRLNIMINIASALEYLHFGCSTPVIHCDLKPSNVLLDDNMVAHLSDFSIAKLLIGEDQSMTHRYKYF
LFLANFLIKYGREGRVSTNGDVYSFGIMLMETFTEKKPTDEIFNEEMTLKQWVNDWLPISTMEVVDANLLSQEDVHFVAK
EQCVSEVENLAMACTVESHEQRINAKEIVTKLLKIRGSLLRNVGGRCLRQSNLN

>XP_024949391.1 probable IRR receptor-like serine/threonine-protein kinase At3g47570 [*Citrus sinensis*]

(SEQ ID NO: 362)

MYTAVEVHKEPDSVGEALQDTNWFTAMKNEYDALIENRTWSLVRRTENQKVVGNKWVYRIKYNTDGSVAKYKARLVAKGE
QQIEGVNYFDTFSPVIKPATVRVVLSLAVMNQWIVRQVDVNNAFLNGELSEEVFIQQPEGFVDKSNLTMFADYTKLYMVL
SKLLEPVTGLNSEELDSFIQQFNTVFALKDLGRLSYFLGIEVLYDQDCIYLSQKKYIRDLLAKVDMLECKRVTTPMCSGK
DSKLQKVVKGELGYYVEDATHYRSIVGGLQYLILTRPEIAYSVHKLSQYVSAPTMQHLMACKRVLKYLKETQDYGLKFVK
DGDLKITAFTDVDWGSDLDDRKSIGAYCVYLGNNLISWSSKKQTVVTKSSAESEYRAFASAASEIAWLKSLFLEMEVYCV
ERPTIWCDNISATELAKNPVFHSRTKHIEIDVHFIRDKVLSGDLKICYVPSEDQIADILTKPLSSPQFNYLRDKLNVESC
PLSLRGAVKIAHCAEVRKKSQRVKLPAVICATCQTAAFIQFYNFLHTGTIPSQLGNLSSLQSLNLSENRLSGSIPSTTFT
TYTLKFVGLQGNQLSGALPFFIENKSSLQDLDLSDNALSGEIPANICSSLPELEYISLSQNMFHGGIPSALSKCTYLQIL
GLSENDESGAIPKEIGNLTKLQELYLGRNRLRGEIPRELSNLAELEQMWLSENELQGGIPQDLGNLAKLKMLQLSQNNLT
VLSENDESGAIPKEIGNLTKLQELYLGRNRLRGEIPRELSNLAELELMSLFDNELQGEIPPEISNLSNLEQLELGSNKLV
GTVPTAIFNVSTLQALGLQNNSLSGSLSSIVDVRLPNLKMLQMWENNFSGTIPRFIFNASKLSILELSDNSFSGFIPNTF
GNLRNLQALRLSNNYLTSSTLEFSFLSSLSNCKSLTLISFSNNPLDGILPKTSVGNLSHSLEYFEMAYCNVSGGIPEEIG
NLTNLTGIYLGGNKLNGSIPSTLGKLQKLQGLGLENNKLEGSIPDSICHSDELYKLELGGNKLSGSIPECENNLASLRIL
LIGSNELTSIPLTFWNIKDILYLNFSSNFFTGPLPLEIGNLKVLVGIDESMNNFSGVIPMAIGGLKNLQNLFLGYNRLQG
SIPDSFGDLISLISLNLSNNNLSGAIPASLEKLSYLENLNLSENKLEGEIPRGGSFGNFSFESFEGNELLCGSPNLRVPP
CKTSIHHISRKNAFLLGIVLPLSTVEMIVVIFLIVKCRKRERGPPNDANMPPEAMQRMFSYLELCRATDGFSENNLIGRG
SFGSVFKARLGDGMEVAMKVENLQYGRVFKSFDVECEMMKSIRHRNIIKVISSCSNEEFKALVLEYMPHGSLEKYLHSSN
YILDIYQRLNIMIDVASALEYLHEGYSAQVIHCDLKPSNVLLDDNMVAHLSDFGIAKLLTREDQSTIQTQTLATIGYMAP
EYGKEGRVSANGDVYSFGIMLMETFTRKKPTDEIENGEMTLKHWVNDWLPISTKEIVDPNLLSREDINEVAKEQCVSFVE
NVAMECTVESPEQRINAKEIVTKLLKIRDSLLRNV

TABLE 4-continued

| Polypeptide sequence of citrus plant positive defense regulators |
|---|
| >XP_006465579.1 LRR receptor-like serine/threonine-protein kinase FLS2 isoform X7 [*Citrus sinensis*] (SEQ ID NO: 363) MERLHSLRMMSRELLLHCLILISLFIAAATANTSSTITDRDALLALKAHITHDPINFLAKNWNTSTPVCNWTGVACDVHS HRVTVLNISSLNLTGTIPSQLGNLSSLQSENLSCNRLFGSIPSAIFTIYTLKYVSLRENQVSGQIPANICSNLPELDYLS LGKNMFHGGIPSALSNCTYLQILHLSYNDESGAVPKDIGNLSKLKELYLGRNRLQGEIPREFVNLTELERMSLSENELQG GIPRELGNETKLEGLQLFRNNLTGGIPRELGNLIKLERLQLEWNNLTGAIPKEIGNLTKLKELSLDGNRLQGEIPLEISN LQNLEELDLRANKLVGTVPAAIFNMSMLKLLHLQNNSLLGCLSSIADVRLPNLEALLLWDNPLDGILSKTSIGGNKINGS IPITLSKLQKLQGLGLDDNKLEGSIPDSICRLTELYELELGGNKLFGSIPACFSNLASLRILSLSSNELTSIPLTFWNLK DILQLNESSNFLTGPLPLEIGNLKVLIGIDFSMNNFSSVIPTEIGGLKNLEYLFLGYNRLEGSIPDSFGDLISLKELNES NNNLSGAIPTSLEKLSYLEDLNLSENKLEGEIPRGGSFGNFAAESFEGNELLCGSPTLQVLPCKTSIHHTSWKNSLLLGI VLPLSTTLLIVVIWLILRYRKRGKQPSNDANMPLVATWRTFSYLELCRATNGFSENNLIGRGGFGSVYKARLGDGMEVAV KVENLQCGRAFKSFAVECEMMKSIRHRNLIKVISSCSNEEFKALVLEYKPHGSLEKYLYSSNCILDIFQRLNIMIDVASA LEYLHEGCSAPVIHCDLKPDNVLLDDNLVAYLSDEGIAKLLIGEDQSMTQTQTLATIGYMAPEYGREGRVSTNGDVYSFG IMLMETFTGKKPTDEIENGEMTLKHWVNDWLPISTMEVVDANLLSQEDVHFVAKEQCVSFVENLAMACTVESHEQRINAK EIVTKLLKIRDSLLRNVGGRRISQPNLN |
| >GAY67779.1 hypothetical protein CUMW_259180 [*Citrus unshiu*] (SEQ ID NO: 364) MMSRELLLHCLILISLFIAASTANSSSTITDRDALLALKARITHDPINFLAKNWNTSTPVCNWTGVACDVHSHRVTVINI SSLNLTGPIPSQLGNLSSLQSLNLSCNRLSGSIPSAIFTTYTLKYVSFRKNQLSGQIPANICSNLPVLEYLSLSQNMFQG GIPSTLSNCTYLRILSLAYNDFSGAVPKDIGNLTKLKELYLGVNRLQGEIPREFGNLAEMELMSLSENKLRGGIPRELGN LTKLEMLQLFQNNLTGKIPREFGNLADLEWMSLWENNLQGAIPRELGNLTGLGILELSHNFLTGKIPPEIGNLRNLEELV LGANQLVGIVPAAIFNVSTLKLLKLQNNFLLGCLSPIEDVRLPNLEELSLWGNNFSGTIPRFIFNASKLSTLELGDNSES GFIPNIFGNLRNLKWLNLPNNYLASSSPELSFLSSLSNCKSLTHLSLSNNPLDGILPRTSVGNLSHSLKKEDMSNCNVSG GIPEEITSLTNLTTIYLGGNKLNGSIPITLSKLQKLQGLGLEDNKLEGSIPDDICRLVELYKVELGGNKLSGSIPACFGN LIALRILSLGSNELTSIPLTFWNLKDILQLNESSNELTGPLPLEIGNLKVLIGIDESMNNFSGVIPTEIGGLKYLEYLFL GYNRLQGLIPDSEGNLISLKELNLSNNNLSGAIPASLEKLLYLEDLNLSENKLEGEIPRGGSEGNFSAESFEGNELLCGS PLQVPPCKTSIHHTSWKISLLLGIVLPLSTTLIIVVIWLILRYRLRGKQPSNDANMPLVATSRTESYLELCRATDGFNEN NLIGRGGFGSVYKARLGDGMEVAVKVENLQCRRAFKSFDVECEIMKSIRHRNLIKVISSCSNEEFKGLVLEYMPQGSLEK HLYSSNCILDIFQRLNIMIDVASALEYLHFGCSTPIIHCDLKPSNVMLDDNMVAYLSDFGIAKLLIGEDQSMTQTQTLAT IGYMAPEYGREGRVSTNGDVYSFGIILMETFTGKKPTDEIFNGEMTLKHWVNDWLPISTMEVVDANLLSQEDIHFAAKEQ CVSFVFNLAMVCTVESLEQRINAKEIVKKLLKIRDSLLRNVGGRCIRQSNLN |
| >GAY66422.1 hypothetical protein CUMW_248620, partial [*Citrus unshiu*] (SEQ ID NO: 365) TANTSSTITDRDALLALKAHITHDPINFLAKNWNTSTPVCNWTGVACDVHSHRVTVLNISSINLTGTIPSQLGNLSSLQS LNLSCNRLSGSIPSAIFTIYTLKYVSFRENQLSGAFSSFIENKSSLQHLDFSHNTLSGEIPANICSSLPELDELSLQENM FHGGIPSTLSNCTYLQKLGLVYNNESGAIPKEIGNLTKLKILYLGGGIPQELGNLAKLEMLQLFQNNLIGEIPLEIGNLQ NLEELELAQNKLIGIVPVAIFNVSTLKILQLQINCLSGSLSSITDVQLPNLEKLDLWGNNESGTIPRFIFNASKLSILNL GGNSESGFIPNTEGNLRNLKYLYLENNYLTSSTLELSELSSLSNCKSLTHIDLSNNPLDGILPKTSVGNLSHSLEDFHMY NCNISGGIPEEISNLTNLITIDLGGNKLNGSILITLSKLQKLQGLVLDDNKLEGSIPDDICREVELYKLELGGNKLSRSI PACENNLIALRILSLGSNELTSIPLTFWNIKDILYLNFSSNFLTGPLPLKIGNLKVLVGIDFSMNNFSGVIPTEIGGLKD LEYLFLGYNRLQGSIPDSEGNLISLKFLNLSNNNLSGAIPAPLEKLSYLEDLNLSENKLEGEIPRGGSFGNESVESEKGN ELLCGSPNLQVPPCKTSIHHTSWKISLLLGILLPLSTTLMIVVIWLILRYRQRGKQPSNDANMPLVAMWRTFSYLELCRA TDGFSENNLIGRGGLGSVYKARLGDGMEVAVKVENLQCRRAFKSEDVECEIMKSIRHRNLIKVISSCSNEEFKGLVLEYK PQGSLEKHLYSSNCILDIFQRLNIMIDVASALEYLHFGCSAPVIHCDLKPDNVLLDDNLVAYLSDEGIAKLLIGEDQSMT QTQTLATIGYMAPEYGREGRISINGDVYSFGIMLMETFTGKKPTDEIFNEEMTLKQWVNDWLPISTMEVVDANLLSQEDV HFVAKEQCVSFVENLAMACTVESPEQRINAKEIVTKLLKIRGSLLRNFGGRCIRQSNLN |
| >XP_006427077.2 probable LRR receptor-like serine/threonine-protein kinase At3g47570 [*Citrus clementina*] (SEQ ID NO: 366) MKIRALPKEIGNLTKLKELSINHNRLQGEIPREFGNLAELELMWLSENNLQGGIPRELGNLTKLEILHLWKNNLTGALPK EIGNLTKLKHLSLDHNRLQGEIPREFGNLAELELLSLYENKLQGEIPLEIGNLRNLKDLILSENKLVGIVPFAIFNVSTL KLLQLQNNSLLGCLSSIANVRLPNLEELDLWANNESGTIPHFIENTSKLSRLDINSNSFSGFIPNTEDNERNLEWLSLRD NYLTSSTPKLSFLSSLSNCNSLRFIDLSDNPLDGILPKTSIGNESHSLKEFYMSNCNVSGGIPEEISNLTHLTTIILGGN KINGSIPITLGKLQKLQGLGLGDNKLEGSIPDDICRLAELYRLELGGNKLYGSIPTCFGNLASLRILSLGSNKLTSIPLT FWNLKDILQLNESSNFLTGPLPLEIGNLKVLIVIDESMNNESGVISTEIGGLKNLEYLFLGYNRERGSIPDSFGDLISEK SINLSNNNLSGAIPTSLEKLSYLEDLNLSENKLEGEIPRGGSFANFSAESFEGNELLCGSPNLQVPPCKTSIHHTSWKNS LLLGIVLPLSTTLLIVVIWLILRYRQRGKQPSNDANMSLVATWRKFSYLELCRATDGFSENNLIGRGGFGSVYKARLGNG MEVAVKVENLQCGRAFKSFDVECEMMKSIRHRNLIKVISSCSNEEFKALVLEYMPHGSLEKYLYSSNCILDIFQRLNIMI DVASALEYLHFGCSALVIHCDLKPSNVLLGDNMVAHLSDFGIAKLLIGEDQSMTQTQTLGTIGYMAPEYGREGRVSANGD VYSFGIMLMETFTGKKPTDEIENGEMTLKHWVNELLPISTMEVVDANLLRQEDIHFAAKEQCVSFIFNLAMACTVESPEQ RINAKEIFVEGGKVDYVLP |
| >XP_006465578.1 probable LRR receptor-like serine/threonine-protein kinase At3g47570 isoform X6 [*Citrus sinensis*] (SEQ ID NO: 367) MERLHSLRMMSRELLLHCLILISLFIAAATANTSSTITDRDALLALKAHITHDPINFLAKNWNTSTPVCNWTGVACDVHS HRVTVLNISSLNETGTIPSQLGNLSSLQSLNLSCNRLFGSIPSAIFTIYTLKYVSLRENQVSGQIPANICSNLPFLDYLS LGKNMFHGGIPSALSNCTYLQILHLSYNDESGAVPKDIGNISKLKELYLGRNRLQGEIPREFVNITELERMSLSENELQG GIPRELGNITKLEGLQLFRNNITGGIPRELGNITKLERLQLFWNNITGAIPKEIGNLTKLKELSLDGNRLQGEIPLEISN LQNLEELDLRHNKLVDVRLPNLEALLLWDNPLDGILSKTSIGNLSHSLKDFYMSNCNVSGGIPEEITNLINSITIDLGGN KLNGSIPITLSKLQKLQGLGLDDNKLEGSIPDSICRETELYELELGGNKLFGSIPACFSNLASLRILSLSSNELTSIPLT FWNLKDILQLNESSNFLTGPLPLEIGNLKVLIGIDESMNNESSVIPTEIGGLKNLEYLFLGYNRLEGSIPDSFGDLISLK FLNLSNNNLSGAIPTSLEKLSYLEDLNLSENKLEGEIPRGGSFGNFAAESFEGNELLCGSPTLQVLPCKTSIHHTSWKNS |

TABLE 4-continued

| Polypeptide sequence of citrus plant positive defense regulators |
|---|
| LLLGIVLPLSTTLLIVVIWLILRYRKRGKQPSNDANMPLVATWRTFSYLELCRATNGESENNLIGRGGFGSVYKARLGDG<br>MEVAVKVENLQCGRAFKSFAVECEMMKSIRHRNLIKVISSCSNEEFKALVLEYKPHGSLEKYLYSSNCILDIFQRLNIMI<br>DVASALEYLHFGCSAPVIHCDLKPDNVLLDDNLVAYLSDFGIAKLLIGEDQSMTQTQTLATIGYMAPEYGREGRVSTNGD<br>VYSFGIMLMETFTGKKPTDEIFNGEMTLKHWVNDWLPISTMEVVDANLLSQEDVHFVAKEQCVSFVENLAMACTVESHEQ<br>RINAKEIVTKLLKIRDSLLRNVGGRRISQPNLN |
| >GAY66430.1 hypothetical protein CUMW_248700, partial [Citrus unshiu]<br>(SEQ ID NO: 368)<br>MSRFLLLHCLTLISLFIAATTANTITITIDQDALLALKAHITHDPINFLAKNWNTSTPVCNWTGVTCDVHSHRVTVLNIS<br>RINLTGTIPSQLGNLSSLQSLNLSFNRFFGSIPSAIFTIYTLKYVSFRENQLSGTFPSLILNKSSLQHLDFTHNTLSGEI<br>PANICREIPQEFGNLVKLELMSLPENKLQGEIPSEIGNFHNLEYLDLSINKLVGVVPSAIFNVSTLKYLGLQNNSLSGSI<br>SSILDFRLPNLEELHLWGNNFSGTIPPFIFNASKLSILELGGNSESGFIPNAFGNLRNLNYLTLYNNYLTSSTPELSFLS<br>SLSNCKSLRLIDLSNNSLDGILPRTSVGNLSHSLEYFDMSYCNVSGGIPEEINNLTNLITIYLAGNKLNGSIPITLSKLQ<br>KLQGLGLQDNKLKGLIPEDICRLAKLYELNLGGNMLSGSIPACFSNLASLRTLSLGENELTSIPSTFWNLKDILYLNESS<br>NFFAGPLPLKIGNLKVLIEIDFSMNNFSGVIPTTIGGLKNLQYLSLGNNRLQGSIPNSVGDLISLKSLNLSNNNLSGAIP<br>VSLEKLTYLKDLDLSENKLEGEIPNGGSFGNFSAESFEGNQLLCGLPNLHVPPCKTSIHHTSWKNALLLGTFLPVSTIEM<br>IVVMLLIVRYRKRGKQALNDANMPPLAKWRMLSYLELCRATDGFSENNLLGRGGFGSVYKARIEDGMDVAVKVENLEYGR<br>AFKSFDVECEIMKSIRHRNLIKVISSCSNEEFKALVTEYMPHGSLEKYLYSSNYNLDIFQRLNIMIDVALALEYLHEGCS<br>ASVIHCDLKPSNVLLDDNMVAHLSDFGIAKLLTGEDQSMIQTQTLATIGYMAPEYGREGRVSANGDVYSEGIMLMETETG<br>KKPTDKIENGEMTLTHWVNNWLPISIMKVADANLISQEDVHFAAKEQCMSFVENLAMECTAESPEQRINAKEIVTRLLKI<br>KDSLLRNVGGLITLCNNSWGV |
| >GAY66432.1 hypothetical protein CUMW_248700, partial [*Citrus unshiu*]<br>(SEQ ID NO: 369)<br>TTANTITITIDQDALLALKAHITHDPINFLAKNWNTSTPVCNWTGVTCDVHSHRVTVENISRLNUTGTIPSQLGNLSSLQ<br>SINLSENRFFGSIPSAIFTIYTLKYVSFRENQLSGTFPSLILNKSSLQHLDFTHNTLSGEIPANICSNLPFLEYFSLFQN<br>MFHGGIPSTLSNCTYLRILSLSSNDFSGPIPKEIGNLTKLKELYLGRNRLHGEIPQEFGNLVKLELMSLPENKLQGEIPS<br>EIGNFHNLEYLDLSLNKLVGVVPSAIFNVSTLKYLGLQNNSLSGSLSSILDFRLPNLEELHLWGNNFSGTIPPFIFNASK<br>LSILELGGNSFSGFIPNAFGNLRNLNYLTLYNNYLTSSTPELSFLSSLSNCKSLRLIDLSNNSLDGILPRTSVGNLSHSL<br>EYFDMSYCNVSGGIPEEINNLTNLITIYLAGNKLNGSIPITESKLQKLQGLGLQDNKLKGLIPEDICRLAKLYELNLGGN<br>MLSGSIPACESNLASLRTLSLGENELTSIPSTFWNLKDILYLNFSSNFFAGPLPLKIGNLKVLIEIDFSMNNESGVIPTT<br>IGGLKNLQYLSLGNNRLQGSIPNSVGDLISLKSENLSNNNLSGAIPVSLEKLTYLKDLDLSENKLEGEIPNGGSFGNFSA<br>ESFEGNQLLCGLPNLHVPPCKTSIHHTSWKNALLLGTFLPVSTIFMIVVMLLIVRYRKRGKQALNDANMPPLAKWRMLSY<br>LELCRATDGESENNLLGRGGFGSVYKARIEDGMDVAVKVENLEYGRAFKSEDVECEIMKSIRHRNLIKVISSCSNEEFKA<br>LVTEYMPHGSLEKYLYSSNYNLDIFQRLNIMIDVALALEYLHFGCSASVIHCDLKPSNVLLDDNMVAHLSDFGIAKLLTG<br>EDQSMIQTQTLATIGYMAPEYGREGRVSANGDVYSFGIMLMETFTGKKPTDKIFNGEMTLTHWVNNWLPISIMKVADANL<br>ISQEDVHFAAKEQCMSFVENLAMECTAESPEQRINAKEIVTRLLKIKDSLLRNVGGLITLCNNSWGV |
| >GAY42605.1 hypothetical protein CUMW_068210 [*Citrus unshiu*]<br>(SEQ ID NO: 370)<br>MERVRSLSMTSRELLLHCLFLISLFIAAATANTSSITTDQDALLALKAHITHDPTNFLAKNWNTSTPVCNWTGVTCDVHS<br>HRVTVLDIFGLNLIGTVPSQLWNLSSLQSLDLGLNRERGSIPSAIFTTYTLKYVNERGNQLSGAFPSLIENKSSLQHLDF<br>SENTLSGEIPANICSNLPFLEYFSLSKNMFHGRIPSTLSNCTYLQILSLSYNNFSGAIPKEIGNLTELKELYLSTNRLQG<br>KIPREFSNLADLEQMTLSKNNLQGEIPPEIGNESNLGWLELGQNKLVGIVPAAIENVSTLKVLDLENNSLSGRLSSLADV<br>RLPNLVALYLWGNNFCGTIPRFIFNASKLSILELEDNSFSGFIPNTFGNLRNLKVLILYDNYLTSSTPELSFLSTLSNCK<br>SLQHIQLLNNPLDGILSRTSVSNLSHSLEYFDMSDCNVSGGIPEEIGNLTNLTTIFLGGNKLHGSIPFTLGKLQKLQYLG<br>LEDNKLEGSIPNDICHLVELFELELGGNKLSGSIPVCFSNLTSERILSLDSNELTSIPSTFWNLTDILYLNFSSNELTGP<br>LPLEIENLKVLVGIDFSMNTFSSVIPTAIGGLENLQSLFLAYNRLQGSIPNSFGDLISLISENLSNNNLSGSIPISLEKL<br>SYLKDLNLSENKLEGEIPRRGSFGNFSAESFEGNELLCGSPNLRVPPCKTSIHHKSRKNTLLLGIVLPLSTIFMIVVILL<br>IVKYGKREKGPPNDANMPPEATERRESYLELCQATDGESQNNLIGRGGFGSVYKARIRDGMEVAVKVENLQCGRAFKSED<br>VECEIMKSIRHRNLIKVISSCSNEEFKALVLEYMPHGSLEKYLYSSSCILDILQRENIMIDVASALEYLHEGYSAPIIHC<br>DLKPNNVLLDNNMVAHLSDFGIAKLLTREDQSMTQTQTLATIGYMAPEYGREGRISINGDVYSFGIMLIETFSGKKPTDE<br>IFNGEMTLKHWVNDWLPISIMEVVDANLLSREDIHFVAKEQCMSFVENLAMECTVESPEQRINAKEIVRRLLKIRDLLL |
| >XP_024952374.1 probable LRR receptor-like serine/threonine-protein kinase At3g47570 [Citrus sinensis]<br>(SEQ ID NO: 371)<br>MESVHSLSIMSRFPLLHYLILISLFIAAETANTRTITTDQDALLALKAHITHDPTNFLAKNWNTSAPVCNWTGVTCDVHS<br>HKVTALNISGLNLTGTIPSQLGNLSSLQSLDLSENRLSGSIPSAIFTTYTLKDVSFRENQLTGVFPSFIENKSSLQHLDF<br>SRNTLSGEIPANICSSLPFLDYLYLSKNMLAGGIPSTLSNCTYLRILSLAYNDESGAVPKDIGNUTKLMGLYLGRNRLQG<br>EIPREFGNLAELEQMSLAENNLQGGIPQELGNLTKLEILELFESNLTGEIPSEIGNLRNLEELDLSHNKLVGTVPAAIEN<br>VSTLKRLGLQNNELSGCLSSISDARLINLEGLYLWGNNFSGTIPDFIFNASKLFQLSLAMNSFFGFIPNTFGNLRNLKWL<br>TLYDNYLTSSTPELSFLSSLSNCKSLTHLSLSNNPLDSVLSRTSVSNLSHSLKELYMSNCNVSGGILEEITNLTNLTAIN<br>LGDNKLNGSIPITLGKLQKLQYLGLENNKLEGSIPDGICCSVELYKLELGGNKLSGSIPACFSNLASLRILSLDSNKLTS<br>IPLNFWNLKDILYLNESSNELTGPLPLEIGNLKVEVGIDLSMNNFSGVIPTEIGGLKNLEYLELGYNRLQGPIPDSEGDL<br>ISLKFLNLSNNNLSGAIPASLEKLSYLENINLSFNKLEGEIPRGGPFRNESVESFEGNELLCGSPNLQVPPCKTSNHHTL<br>WKNSLLLRIVLPLSAIFMIVVILLILRYRQKGKRPSNDANMPSIATWRTFSHLELCRATDGESENNLIGRGGFGSVYKAR<br>LGDGMEVAVKVENLQCGRALKGEDVECEMMKSIRHRNLIKVISTCSNEEFKALVLEYMPHGSLEKYMYSSNYILDIFQRL<br>NIMIDVASALEYLHEGYSAPIIHCDLKPSNVLLDDNMVAHLSDFSIAKLLTGEDQSMTQTQTLATIGYMAPEYGREGRVS<br>TNGDVYSFGIMLMETFTGKKPTNEIENGEMTLKHWVNDWLPISTMEVVGANLLSQEDIHFVAKEQCVSCVENLAMECTVE<br>SPEQRINAREIDLAYIEQKQKEKLEKGKVVVGARTTKEKGNIWLWLELVVGAGSTKERGNIWLWLELVARARSTKEMKRK<br>IFGCGWSSWLKLDRRRKGKGKYLGGAPGTKKMGNIWQVKTATFLALTKRCV |
| >GAY42604.1 hypothetical protein CUMW_068210 [*Citrus unshiu*]<br>(SEQ ID NO: 372)<br>MERVRSLSMTSRELLLACLFLISLFIAAATANTSSITTDQDALLALKAHITHDPINFLAKNWNTSTPVCNWTGVTCDVHS<br>HRVTVLDIFGLNLIGTVPSQLWNLSSLQSLDLGLNRERGSIPSAIFTTYTLKYVNERGNQLSGAFPSLIENKSSLQHLDF |

TABLE 4-continued

| Polypeptide sequence of citrus plant positive defense regulators |
|---|
| SENTLSGEIPANICSNLPFLEYFSLSKNMFHGRIPSTLSNCTYLQILSLSYNNESGAIPKEIGNLTELKELYLSTNRLQG KIPREFSNLADLEQMTLSKNNLQGEIPQELGNLTGLETLLLYYNFLTGEIPPEIGNFSNLGWLELGQNKLVGIVPAAIEN VSTLKVLDLENNSLSGRLSSLADVRLPNLVALYLWGNNFCGTIPRFIFNASKLSILELEDNSFSGFIPNTEGNLRNLKVL ILYDNYLTSSTPELSFLSTLSNCKSLQHIQLLNNPLDGILSRTSVSNLSHSLEYEDMSDCNVSGGIPEEIGNLINLTTIF LGGNKLHGSIPFTLGKLQKLQYLGLEDNKLEGSIPNDICHLVELFELELGGNKLSGSIPVCFSNITSLRILSLDSNELTS IPSTFWNLTDILYLNFSSNFLTGPLPLEIENLKVLVGIDFSMNTFSSVIPTAIGGLENLQSLFLAYNRLQGSIPNSFGDL ISLISINLSNNNLSGSIPISLEKLSYLKDLNLSENKLEGEIPRRGSFGNFSAESFEGNELLCGSPNLRVPPCKTSIHHKS RKNTLLLGIVLPLSTIFMIVVILLIVKYGKREKGPPNDANMPPEATLRRFSYLELCQATDGFSQNNLIGRGGFGSVYKAR IRDGMEVAVKVENLQCGRAFKSFDVECEIMKSIRHRNLIKVISSCSNEEFKALVLEYMPHGSLEKYLYSSSCILDILQRL NIMIDVASALEYLHEGYSAPIIHCDLKPNNVLLDNNMVAHLSDFGIAKLLTREDQSMTQTQTLATIGYMAPEYGREGRIS TNGDVYSFGIMLIETFSGKKPTDEIENGEMTLKHWVNDWLPISIMEVVDANLLSREDIHFVAKEQCMSFVENLAMECTVE SPEQRINAKEIVRRLLKIRDELL |
| >GAY68421.1 hypothetical protein CUMW_263980 [*Citrus unshiu*] (SEQ ID NO: 373) |
| MERAHSLMMMSRFLLLHCLILISLFIAAATANTSSTITDQDALLALKAHITHDPINFLAKNWNTSTPVCNWTGVACEVHS QRVTVENISSLNETGTIPSQLGNLSSLQSLNLSENRLEGSIPSAIFTTYTLKYVCLRGNQLSGTFPSFISNKSSLQHLDL SSNALSGEIRANICREIPREFGNLPELELMSLAANNLQGKIPLKIGNLRNLEKLDIGDNKLVGIAPIAIENVSTLKILGL QDNSLSGCLSSIGYARLPNLEILSLWGNNESGTIPRFIFNASKLSILDLEGNSFSGFIPNTFGNLRNLSWLVLSDNYLTS STQELSFLSSLSNCKELKYFDLSYNPLYRILPRTIVGNLSHSLEEFKMSNCNISGGIPEEISNLINLRTIYLGGNKINGS ILITLSKLQKLQDLGLKDNKLEGSIPYDICNLAELYRLDLDGNKLSGSIPACFSNLTSLRIVSLGSNELTSIPLTFWNLK DILNLNFSSNELTGSLPLEIGSLKVLVGIDLSRNNESGVIPTEIGGLKNLEYLFLGYNRLQGSIPNSFGDLISLKELNLS NNNLSGVIPASLEKLSYLEDENLSENQLEGKIPRGGSFGNFSAQSFEGNELLCGSPNLQIPPCKTSIHHKSWKKSILLGI VLPLSTTEMIVVILLILRYQRQRGKRPSNDANGPLVASRRMFSYLELCRATDGFSENNLIGRGGFGFVYKASLGDGMEVAV KVFTSQCGRAFKSFDVECEIMKSIRHRNLIKVISSCSNEEFKALVLEYMPHGSLEKYLYSSNCILDIFQRLNIMIDVASA LEYLHEGYSAPVIHCDLKPSNVLLDDNMVAHLSDFSIAKMLTGEDQSMIQTQTLATIGYMAPEYGREGRVSANGDVYSEG IMLMETFTGKKPTDEIENGEMTLKHWVNNWLPISTMEVVDANLLSQEDIHEVAKEQCVSFVENLAMECTMEFPKQRINAK EIVTKLLKIRDSLLRNVGGRCVMKF |
| >GAY68423.1 hypothetical protein CUMW_263980 [*Citrus unshiu*] (SEQ ID NO: 374) |
| MERAHSIMMMSRELLLACLILISLFIAAATANTSSTITDQDALLALKAHITHDPINFLAKNWNTSTPVCNWTGVACEVHS QRVTVENISSLNLTGTIPSQLGNLSSLQSLNLSENRLEGSIPSAIFTTYTLKYVCLRGNQLSGTFPSFISNKSSLQHLDL SSNALSGEIRANICSNLPFLEYLAFFKNMLHGGIPSTLSNCTYLRTLDESYNDFSEAIPKDIGNLTNLKELYLGRNRLQG EIPREFGNLPELELMSLAANNLQGKIPLKIGNLRNLEKLDIGDNKLVGIAPIAIFNVSTLKILGLQDNSLSGCLSSIGYA RLPNLEILSLWGNNESGTIPRFIFNASKLSILDLEGNSFSGFIPNTFGNLRNLSWLVLSDNYLTSSTQELSFLSSLSNCK FLKYFDLSYNPLYRILPRTIVGNLSHSLEEFKMSNCNISGGIPEEISNLTNLRTIYLGGNKINGSILITLSKLQKLQDLG LKDNKLEGSIPYDICNLAELYRLDLDGNKLSGSIPACESNLTSLRIVSLGSNELTSIPLTEWNLKDILNLNESSNFLTGS LPLEIGSLKVLVGIDLSRNNESGVIPTEIGGLKNLEYLFLGYNRLQGSIPNSFGDLISLKFLNLSNNNLSGVIPASLEKL SYLEDINLSFNQLEGKIPRGGSFGNFSAQSFEGNELLCGSPNLQIPPCKTSIHHKSWKKSILLGIVLPLSTTFMIVVILL ILRYRQRGKRPSNDANGPLVASRRMFSYLELCRATDGFSENNLIGRGGFGFVYKASLGDGMEVAVKVFTSQCGRAFKSED VECEIMKSIRHRNLIKVISSCSNEEFKALVLEYMPHGSLEKYLYSSNCILDIFQRLNIMIDVASALEYLHEGYSAPVIAC DLKPSNVLLDDNMVAHLSDFSIAKMLTGEDQSMIQTQTLATIGYMAPEYGREGRVSANGDVYSFGIMLMETFTGKKPTDE IFNGEMTLKHWVNNWLPISTMEVVDANLLSQEDIHFVAKEQCVSFVENLAMECTMEFPKQRINAKEIVTKLLKIRDSLLR NVGGRCVMKE |
| >GAY63063.1 hypothetical protein CUMW_222620 [*Citrus unshiu*] (SEQ ID NO: 375) |
| MERVHSLSMISRFLLLHCLVLIFLFIAAATANTSTITTDQDALLALKAHISHDPTNFLAKNWNKSTPICNWTGVTCDVHS HRVTVLNISSLNLTGTVPAQLGNLSSLQSLDLSENRLSGFIPSTIFTMYTLKRVSFRENQLSGTFPSFIENKSSLQHLDE SHNTLSGEIPANICSNLPFLEYISLSQNMFHGRIPPTLSNCTYLRILGLSENNFSGAIPKEISYLTKLKELYLGVNRLQG EIPREVGNLAELELMSLPENKLQGEIPQELGNLVGLEFLFLSDNFLTGTIPKEISNFTNLQDLGLDSNRLQGEIPPEIGN LRSLEWLLLGYNKLVGTIPAAIFNVSTLKQLDLQNNSLSGSLSSIADVRLPNLEMIYMWGNNESGTIPRFIFNASKLSIL SLEKNSESGFIPNTFGNLRNLEQLDLSDNYLTSSTPELSFLSSLSNCKSLTHIRLSDNPLNGILPRTTVGNLSHSLELED MSYCNISGSIPKEISNLTNETTIYLVGNKINGLIPITLGKLQKLQSLVLEDNKLKGSIPDDICRLAELYELNLGGNKLSG SIPACESNLASLRTLSLSSNELTSIPLTLWNLKDILYLNFSSNFLSGPLPLEIENLKVLVGIDFSMNNESSVIPTTIGSL KDLQYLLLAYNKLQGSIPDSVGDLISLKSLNLSNNNLSGAIPVSLEKVSYLENLDLSENKLEGEIPKGGSEGNFSAESFE GNELLCGSPNLQVPPCKISIHHASRKNALLLGTALPLSTIFMIVVILLILKCRKRRKRPSDDANIPPVPTLRRFSYLELY QATNGFGENNLIGRGGFGSVYKARIQDGIEVAVKVENLQCGRAFKSFDVECQVMKSIRHRNLIKVISSCSNEEFKALVLE YMPHGSLEKYLYSSNCILDIFQRLNIMIDVASALEYLHFGYSTPVIHCDLKPNNVLLDNNMVAHLSDFGIAKLLTGEDQF VTQTQTLATIGYMAPEYGREGRVSTNGDVYSFGIMLMETFTGKKPTDKIENGEMTLKRWICDWIPISIMEVVDANLLSRE DIHFVAKEQCLSFVENLAMDCTVECPEQRINAKEIVTRLLKIRDSLLRNVEGRCIRQSNLN |
| >KDO39417.1 hypothetical protein CISIN_1g0020211mg, partial [*Citrus sinensis*] (SEQ ID NO: 376) |
| KIPLKIGNLRNLEKLDIGDNKLVGIAPIAIFNVSTLKILGLQDNSLSGCLSSIGYARLPNLEILSLWGNNESGTIPRFIF NASKLSILDLEGNSESGFIPNTFGNLRNLSWLVLSDNYLTSSTQELSFLSSLSNCKELKYFDLSYNPLYRILPRITVGNL SHSLEEFKMSNCNISGGIPEEISNLTNLRTIYLGGNKLNGSILITLSKLQKLQDLGLKDNKLEGSIPYDICNLAELYRLD LDGNKLSGSIPACFSNLTSLRIVSLGSNELTSIPLTFWNIKDILNLNESSNFLTGSLPLEIGSLKVLVGIDESRNNESGV IPTEIGGLKNLEYLFLGYNRLQGSIPNSFGDLISLKFLNLSNNNLSGVIPASLEKLSYLEDINLSENQLEGKIPRGGSFG NFSAQSFEGNELLCGSPNLQIPPCKTSIHHKSWKKSILLGIVLPLSTTFMIVVILLILRYRQRGKRPSNDANGPLVASRR |

TABLE 4-continued

| Polypeptide sequence of citrus plant positive defense regulators |
|---|
| MFSYLELCRATDGFSENNLIGRGGFGSVYKASLGDGMEVAVKVFTSQCGRAFKSEDVECEIMKSIRHRNLIKVISSCSNE EFKALVLEYMPHGSLEKYLYSSNCILDIFQRLNIMIDVASALEYLHFGYSAPVIHCDLKPSNVLLDDNMVAHLSDESIAK MLTGEDQSMIQTQTLATIGYMAPEYGREGRVSANGDVYSFGIMLMETFTGKKPTDEIENGEMTLKHWVNDWLPISTMEVV DANLLSQEDIHFVAKEQCVSFVENLAMECTMEFPKQRINAKEIVTKLLKIRDSLLRNVGGRCVRQSNLN |
| >GAY63065.1 hypothetical protein CUMW_222610 [*Citrus unshiu*] (SEQ ID NO: 377) |
| MERVHSLSMISRELLLHCLVLIFLFIAAATANTSTITTDQDALLALKAHISHDPINFLAKNWNKSTPICNWTGVTCDVHS HRVTVENISSLNETGTVPAQLGNLSSLQSLDLSFNRLSGFIPSTIFTMYTLKRVSFRENQLSGTFPSFIENKSSLQHLDE SHNTLSGEIPANICSNLPFLEYISLSQNMFHGRIPPTLSNCTYLRILGLSENNESGAIPKEISYLTKLKELYLGVNRLQG EIPREVGNLAELELMSLPENKLQGEIPQELGNLVGLEFLFLSDNELTGEIPPEIGNLRSLEWLLLGYNKLVGTIPAAIEN VSTLKQLDLQNNSLSGSLSSIADVRLPNLEMIYMWGNNFSGTIPRFIFNASKLSILSLEKNSESGFIPNTEGNLRNLEQL DLSDNYLTSSTPELSFLSSLSNCKSLTHIRLSDNPLNGILPRTTVGNLSHSLELFDMSYCNISGSIPKEISNLTNITTIY LVGNKLNGLIPITLGKLQKLQSLVLEDNKLKGSIPDDICRLAELYELNLGGNKLSGSIPACFSNLASLRTLSLSSNELTS IPLTLWNLKDILYLNFSSNFLSGPLPLEIENLKVLVGIDESMNNFSSVIPTTIGSLKDLQYLLLAYNKLQGSIPDSVGDL ISLKSLNLSNNNLSGAIPVSLEKVSYLENLDLSENKLEGEIPKGGSFGNFSAESFEGNELLCGSPNLQVPPCKISIHHAS RKNALLLGTALPLSTIFMIVVILLILKCRKRRKRPSDDANIPPVPTLRRESYLELYQATNGEGENNLIGRGGFGSVYKAR IQDGIEVAVKVENLQCGRAFKSFDVECQVMKSIRHRNLIKVISSCSNEEFKALVLEYQAMPHGSLEKYLYSSNCILDIFQRL NIMIDVASALEYLHFGYSTPVIHCDLKPNNVLLDNNMVAHLSDEGIAKLLTGEDQFVTQTQTLATIGYMAPEYGREGRVS TNGDVYSEGIMLMETFTGKKPTDKIFNGEMTLKRWICDWIPISIMEVVDANLLSREDIHFVAKEQCLSFVENLAMDCTVE CPEQRINAKEIVTRLLKIRDSLLRNVEGRCIRQSNLN |
| >XP_024036863.1 probable LRR receptor-like serine/threonine-protein kinase At3g47570 [*Citrus clementina*] (SEQ ID NO: 378) |
| MNSFSGFIPSTEGNLRNLEWLTLYDNNLTSSTLDLSELSSLSNCKSLTHISLSNNPLDGILPRTYVGNLSHSLKNFYMYN CNVSGGIPEEITNLIDLTTIVIGGNKLNGSIPITLGKLQKLQDVDLEYNQLEGSIPDSICLSVELYELELGGNKLSGSIP ACFSNMTFLKVLSLGSNELTSIPLNFWSLKDILDLNLSSNCFSGPLPLEIRNLKALIEIDFSMNNESGIIPMEIGSLKNL ENLFLEYNRLEGSIPDSFGDLISLKSLNLSYNNLSGTIPVSLEKLSYLKDENLSENKLKGEIPRGGSFGNESAESEKGNE LLCGSPNLQVPPCKASIHRTSRKNALILGIVLPFSTIFMTAIILFIIKYQKREKGPPNDPNMPPVATWRRFSYLELFQAT DKFSENNLIGRGGFGSVYKARIRDGMEVAVKVENLQCGRAFKSFDVECAMMKSIRHRNLVKVISSCSNEEFKALVLEYMP HGSLEKYLHSSNYSLDIFQRLNIMIDVASALEYLAFGYSAPVIHCDLKPSNVLLDDNMVAHLSDEGIAKLLTGEDQSMTQ TQTLATIGYMAPEYGREGQVSTNGDVYSFGIMLMETFTRKKPTDELENGEMTLKHWVNDCLPISTMEVVDANLLSQEDIH FVAKEQCVSFVENLALECTVESPEQRINAKEIVAKLLKIRDSLERNVGGRCIRQSNLN |
| >XP_006465576.1 probable LRR receptor-like serine/threonine-protein kinase At3g47570 isoform X4 [*Citrus sinensis*] (SEQ ID NO: 379) |
| MERLHSLRMMSRELLLHCLILISLFIAAATANTSSTITDRDALLALKAHITHDPINFLAKNWNTSTPVCNWTGVACDVHS HRVTVLNISSLNLTGTIPSQLGNLSSLQSENLSCNRLFGSIPSAIFTIYTLKYVSLRENQVSGQIPANICSNLPELDYLS LGKNMFHGGIPSALSNCTYLQILHLSYNDESGAVPKDIGNLSKLKELYLGRNRLQGEIPREFVNITELERMSLSENELQG GIPRELGNETKLEGLQLFRNNLTGGIPRELGNLIKLERLQLEWNNLTGAIPKEIGNLTKLKELSLDGNRLQGEIPLEISN LQNLEELDLRANKLVGTVPAAIFNMSMLKLLHLQNNSLLGCLSSIADVRLPNLEALLWGNNFSGTIPRFIFNASKLSIL ELSQNSESGFIPNTFGNLRNLEWINLRDNYLTSSTPELSFLSSLSNCKSLTFIHLSDNPLDGILSKTSIGGNKLNGSIPI TLSKLQKLQGLGLDDNKLEGSIPDSICRLTELYELELGGNKLFGSIPACFSNLASLRILSLSSNELTSIPLTFWNLKDIL QLNFSSNELTGPLPLEIGNLKVLIGIDFSMNNESSVIPTEIGGLKNLEYLFLGYNRLEGSIPDSFGDLISLKFLNLSNNN LSGAIPTSLEKLSYLEDINISENKLEGEIPRGGSEGNFAAESFEGNELLCGSPTLQVLPCKTSIHATSWKNSLLLGIVEP LSTTLLIVVIWLILRYRKRGKQPSNDANMPLVATWRTFSYLELCRATNGFSENNLIGRGGFGSVYKARLGDGMEVAVKVE NLQCGRAFKSFAVECEMMKSIRHRNLIKVISSCSNEEFKALVLEYKPHGSLEKYLYSSNCILDIFQRLNIMIDVASALEY LHFGCSAPVIHCDLKPDNVLLDDNLVAYLSDFGIAKLLIGEDQSMTQTQTLATIGYMAPEYGREGRVSTNGDVYSFGIML METFTGKKPTDEIFNGEMTLKHWVNDWLPISTMEVVDANLLSQEDVHFVAKEQCVSEVENLAMACTVESHEQRINAKEIV TKLLKIRDSLLRNVGGRRISQPNLN |
| >KDO48826.1 hypothetical protein CISIN_19040845mg [*Citrus sinensis*] (SEQ ID NO: 380) |
| MPSIINNELTSTTPKEIDNISNLKVLYLYNNRLQGEIIHEIGHLHNLGELDLSQNKLLGTIPAAIFNVSTLKAFAVINNS LSGCLSSITDVGLPNLEVLYLWGNNFSGTIPHFIFNASKLSKLALEMNSESGFIPSTEGNLRNLEWLTLYDNNLTSSTLD LSFLSSLSNCKSLTHISLSNNPLDGILPRTYVGNLSHSLKNEYMYNCNVSGGIPEEITNLTDLTTIVIGGNKLNGSIPIT LGKLQKLQDVDLEYNQLEGSIPDSICLSVELYELELGGNKLSGSIPACFSNMTFLKVLSLGSNELTSIPLNEWSLKDILD LNLSSNCFSGPLPLEIRNLKALIEIDFSMNNFSGIIPMEIGSLKNLENLFLEYNRLEGSIPDSFGDLISLKSLNLSYNNL SGTIPVSLEKLSYLKDLNLSFNKLKGEIPRGGSFGNFSAESFKGNELLCGSPNLQVPPCKASIHRTSRKNALILGIVLPF STIFMTAIILFIIKYQKREKGPPNDPNMPPVATWRRFSYLELFQATDKFSENNLIGRGGFGSVYKARIRDGMEVAVKVEN LQCGRAFKSEDVECAMMKSIRHRNLVKVISSCSNEEFKALVLEYMPHGSLEKYLHSSNYSLDIFQRLNIMIDVASALEYL HEGYSAPVIHCDLKPSNVLLDDNMVAHLSDFGIAKLLTGEDQSMTQTQTLATIGYMAPEYGREGQVSTNGDVYSFGIMLM ETFTRKKPTDELENGEMTLKHWVNDCLPISTMEVVDANLLSQEDIHFVAKEQCVSFVENLALECTVESPEQRINAKEIVA KLLKIRDSLLRNVGGRCIRQSNEN |
| >GAY47648.1 hypothetical protein CUMW_106000 [*Citrus unshiu*] (SEQ ID NO: 381) |
| MHKDSKVWTILAPQENCQEGGVGSANYSKISKGDTDILADDLQVAMKENIHELIVVGCQREEYSIYDLLYLTVRYHMKSL SDNKLVGVVPATIFNLSTLRVFAVSNNSLLGSLQSSADVQLPNLEGIYLWGNNFSGTIPSFIENASKLSTLALEDNSFFG FIPNTEGNLGNLRWENIENNYLTSSTPELNFLSSLSNSKYLKVLELSYNPLNGILPRTSMGNLSHSLEKEVMINCNVGGA IPEEISNLTNLRMIGFSGNKLNGSIPITLCKLQKLQLLSFRDNKLEGSIPEDVCSLAELYQLHLGGNKESRSIPTCIGNL TSLRTLSLGSNELISVIPSTLWNLEYIMNLNFSSNFLTGPLPLEIGNLKVLVGIDFSMNNESGAIPTTIGGLTDLQYLLL GHNKLEGSIPNPIGDLISLEYLDLSNNNLSGPIHVSLEKLLYLKDLNLSENNLEGEIPKGGSFRNFSAKSFEGNKLLCGS PNLQVPPCKTSIHHTSRKNALLLGIVLPLSIVSMIVVILLISRYRKRGKQLPNDANMPPVATWFKLFQATDGESENNLIG RGSFGSVYKARIQDGMEVAVKVFHLQCGGVEKSEDVECEVMKSIRHRNLIKIISTCSNDDFKALVLEYMPHGSLEKCLYS |

TABLE 4-continued

Polypeptide sequence of citrus plant positive defense regulators

SNCILDIFQRLNIMIDIAVALEYLHFGYSAPVIHCDLKPSNVLLDDNMVAHLSDFGIAKLLTGEDQSKSQTQTLATIGYM
APEYGREGRVSTNGDVYSFGIMLMETFTKKKPTDKIFAGEMTLKYWVSNLLPISVMEIVDANLLSREDKHFAAKEQCVSF
VENFAMECTVESAEQRINAKEIVTRLLKIRDSLLICTRESKLN

>GAY65414.1 hypothetical protein CUMW_240950 [*Citrus unshiu*]
(SEQ ID NO: 382)
MSRSLLRHCLILISLFIAAATANTSTTTADQDGLLALKAHITHDPTNFLAKNWNTRTLVCNWTGVTCDVHSHRVTILNIS
RINLIGTIPSQLGNLSSLQSLDLSFNQLSGSIPSAIFSTYTLKYVNFRENQLSGAFPSLIENKSSLQLLDFAHNTLSDEI
PANICREIPQEFGNLAELEQMSLSENKLQGEIPHEIGNLRNLELLVLSHNRLVGVIPTKVENVSTLKVFEVSNNSLSGSL
SSIAGVRLPNLEVLRMRSNNFCGTIPHFIFNASKLSLLELGDNSESGFIPDTFGNLRNLNKVTLYNNYLTSSTSDLNFLS
SLSNCKTLTYIDLSDNPLDGILPGTSVGNLSHSLEYFYMPNCNVSGGIPEEISNETNLIIIYLGGNKLNGSIPITLSKLQ
KLQGLSLADNKLEGSIPNNICRLTELYELDLGSNKESRSIPACFSNLASLRTLSLGSNELTSIPLTFWNLKDILYLNESS
NFLTGPLPLEIENLKVLVGIDESVNNFSGVIPTTIGSLKGLQYLFVGYNRLQGSIPYSIGDLISLKSLNLSNNNLSGTIP
VSLEKLSYLEDINLSENKLAGEIPRGGSEGNFSAESFEGNELLCGSPNERVPPCKTSTHHTSWKNALLLGTVLPLSTIEM
IVVILLILRYRKRVKPPPNDANMPPVATWRRFSYLELCRATDRESENNLIGRGGFGSVYKARIQDGMEVAVKVFHLHCSG
AFKSEDVECNVMKNIRHRNLIKIISSCSNDDFKALVLEYMPHGSLEKCLYSSNCILDIFQRLSIMVDVASALEYLHENYS
APIIHCDLKPSNVLLDDNMVAHLSDFGIAKLLIGEDQSMTQTQTLATIGYMAPEYGREGRVSTNGDVYSFGIMLIEAFTR
KKPTDEMFSGEMTLKRWINDLLSVSVMEVVDANLLTREDRHFAAKQQCVSFVENLAMECTIESPERRINAKEIVTELSKI
RDSLERNVGADE >GAY65413.1 hypothetical protein CUMW_240950 [*Citrus unshiu*]
(SEQ ID NO: 383)
MERVHSLSMMSRSLLRHCLILISLFIAAATANTSTTTADQDGLLALKAHITHDPINFLAKNWNTRTLVCNWTGVTCDVHS
HRVTILNISRLNETGTIPSQLGNLSSLQSLDLSFNQLSGSIPSAIFSTYTLKYVNFRENQLSGAFPSLIFNKSSLQLLDE
AHNTLSDEIPANICSNLPFLEILSLSQNMEHGGIPSTLSNCTYLQKLSLPYNDESGAIPKEIGNENKLKRLYLGRNRLQG
EIPQEFGNLAELEQMSLSENKLQGEIPHEIGNLRNLELLVLSHNRLVGVIPTKVENVSTLKVFEVSNNSLSGSLSSIAGV
RLPNLEVLRMRSNNFCGTIPHFIFNASKLSLLELGDNSFSGFIPDTFGNLRNLNKVTLYNNYLTSSTSDLNFLSSLSNCK
TLTYIDLSDNPLDGILPGTSVGNLSHSLEYFYMPNCNVSGGIPEEISNLTNLIIIYLGGNKLNGSIPITLSKLQKLQGLS
LADNKLEGSIPNNICRLTELYELDLGSNKFSRSIPACFSNLASLRTLSLGSNELTSIPLTFWNLKDILYLNESSNFLTGP
LPLEIENLKVLVGIDFSVNNESGVIPTTIGSLKGLQYLFVGYNRLQGSIPYSIGDLISLKSINLSNNNLSGTIPVSLEKL
SYLEDENLSENKLAGEIPRGGSFGNFSAESFEGNELLCGSPNLRVPPCKTSTHATSWKNALLLGTVLPLSTIFMIVVILL
ILRYRKRVKPPPNDANMPPVATWRRFSYLELCRATDRESENNLIGRGGFGSVYKARIQDGMEVAVKVFHLHCSGAFKSED
VECNVMKNIRHRNLIKIISSCSNDDFKALVLEYMPHGSLEKCLYSSNCILDIFQRLSIMVDVASALEYLHENYSAPIIHC
DLKPSNVLLDDNMVAHLSDFGIAKLLIGEDQSMTQTQTLATIGYMAPEYGREGRVSINGDVYSFGIMLIEAFTRKKPTDE
MESGEMTLKRWINDLLSVSVMEVVDANLLTREDRHFAAKQQCVSFVENLAMECTIESPERRINAKEIVTELSKIRDSLER
NEID >XP_006468119.1 receptor kinase-like protein Xa21 isoform X1 [*Citrus sinensis*]
(SEQ ID NO: 384)
MERVHSLSMMSRFLFLHCLILISLLTAAATANTSSITTDQDALLALKAHITHDPTNFLAKNWNTSTPVCNWTGVTCDVHS
HRVKVLNISHLNLTGTIPSQLWNLSSLQSLNLGENRESGSIPSAIFTLYTLKYVNERGNQLSGAFPSFIENKSSLQHLDE
SYNALSGEIPANICSNLPFLESISLSQNMFHGRIPSALSNCKYLEILSLSINNLLGAIPKEIGNETKLKELYLGYSGLQG
EIPREFGNLAELELMALQVSNLQGEIPQELANLTGLEVLKLGKNELTGEIPPEIHNLHNLKLLDLSHNKLVGAVPATIEN
MSTLTRLGLQSNSLSGSLSSIADVQLPNLEELRLWSNNFSGTIPRFIFNASKLSVLELGRNSFSGFIPNTFGNLRNLRLM
TLHYNYLTSSNLELSFLSSFSNCKSLTYIGLSNNPLDGILPRMSMGNLSHSLEYFDMSYCNVSGGFPKEIGNLTNLIGIY
LGGNKINGSIPITLGKLQKLQGLHLEDNKLEGPIPDNICRLTKLYELELSGNKLSGSIPACESNLASLGTLSLGSNKITS
IPLTIWNLKGMLYLNFSSNFFTGPLPLDIGNLKVLVGIDFSMNNFSDVIPTAIGGLINLQYLFLGYNRLQGSIPESFGDL
ISLKSENLSNNNLSGSIPISLEKLSYLEYLDLSENKLKGEIPKGGSFGNFSAESFEGNELLCGSPNLQVPPCKTSIHHKS
RKNVLLLGIVLPLSTIFIIVVILLIVRYRKRVKQPPNDANMPPIATCRRESYLELCRATNRFSENNLIGRGGFGSVYKAR
IGEGMEVAVKVEDLQCGRAFKSFDVECEMMKSIRHRNLIKVISSCSTEEFKALILEYMPHGSLEKSLYSSNYILDIFQRL
NIMVDVATTLEYLHFGYSAPVIHCDLKPSNVLLDDNMVAHLSDFGIAKLLIGEDQSITQTQTLATIGYMAPEYGREGRIS
RNGDVYSFGIILMETFTGKKPTDEIFNEEMTLKHWVNDWLPISIMKVIDANMLSREDIHFVAKEQCVSFVENLAMECTVE
SPQQRINAKEIVTRLLKIRDSLLRNVGGRCIRQSNLN >XP_006494782.2 probable LRR receptor-like serine/threonine-protein kinase At3g47570 [*Citrus sinensis*]
(SEQ ID NO: 385)
MERAHSLMMMSRFLLLHCLILISLFIAAATANTSSTITDQDALLALKAHITHDPINFLAKNWNTSTPVCNWTGVACEVHS
QRVTVENISSLNETGTIPSQLGNLSSLQSLNLSENRLEGSIPSAIFTTYTLKYVCLRGNQLSGTFPSFISNKSSLQHLDL
SSNALSGEIRANICSNLPFLEYLAFFKNMLAGGIPSTLSNCTYLRTLDESYNDESEAIPKDIGNUTNLKELYLGRNRLQG
EIPREFGNLPELELMSLAANNLQGGIPHELGNLAKLEILELFENNLIGKIPLKIGNLRNLEKLDIGDNKLVGIAPIAIFN
VSTLKILGLQDNSLSGCLSSIGYARLPNLEILSLWGNNFSGTIPRFIFNASKLSILDLEGNSFSGFIPNTFGNLRNLSWL
VLSDNYLTSSTQELSFLSSLSNCKFLKYFDLSYNPLYRILPRTTVGNLSHSLEEFKMSNCNISGGIPEEISNLTNLRTIY
LGGNKUNGSILITLSKLQKLQDLGLKDNKLEGSIPYDICNLAELYRLDLDGNKLSGSIPACESNLTSLRIVSLGSNELTS
IPLTFWNLKDILNLNFSSNELTGSLPLEIGSLKVEVGIDLSRNNFSGVIPTEIGGLENLEYLELGYNRLQGSIPNSEGDL
ISLKFLNLSNNNLSGVIPASLEKLSYLEDENLSFNQLEGKIPRGGSFGNFSAQSFEGNELLCGSPNLQIPPCKTSIHHKS
WKKSILLGIVLPLSTTFMIVVILLILRYRQRGKRPSNDANGPLVASRRMFSYLELCRATDGFSENNLIGRGGFGSVYKAS
LGDGMEVAVKVFTSQCGRAFKSFDVECEIMKSIRHRNLIKVISSCSNEEFKALVLEYMPHGSLEKYLYSSNCILDIFQRL
NIMIDVASALEYLHFGYSAPVIHCDLKPSNVLLDDNMVAHLSDESIAKMLIGEDQSMIQTQTLATIGYMAPEYGREGRVS
ANGDVYSFGIMLMETFTGKKPTDEMENGEMTLKHWVNDWLPISTMEVVDANLLSQEDIHFVAKEQCVSEVENLAMECTME
FPKQRINAKEIFVERGKVDYALS >GAY68700.1 hypothetical protein CUMW_266180 [*Citrus unshiu*]
(SEQ ID NO: 386)
MERVHSLSMMSRFILLHCLILISLLTAAATANTSSITTDQDALLALKAHITHDPINFLAKNWNTSTPVCNWTGVTCDAHR
HRVKVLNISHLNLTGTIPSQLWNLSSLQSLNLGENRLSGSIPSAIFTMYTLKYVNERGNQLSGAFPSFIENKSSLQRLDE
SYNALSGEIPANICSNLPFLEYFSLSQNMFHGGIPSTLSNCKYLEILSLSINNLLGAIPKEIGNETKLKELYLGYSGLQG TABLE 4-continued

| Polypeptide sequence of citrus plant positive defense regulators |
|---|
| EIPREFGNLAELELMALQVSNLQGEIPQELANLTGLEVLQLDKNFLTGEIPPEIHNLHNLKLLDLSHNKLVGAVPATIEN<br>MSTLTGLGLQSNSLSGSLSSIADVQLPNLEELRLWSNNFSGTIPRFIFNASKLSVLELGINSESGFIPNTEGNLRNERLL<br>TLHYNYLTSSNLELSELSSESNCKSLTYIGLSNNPLDGILPRMSMGNLSHSLEYFDLSYCNVSGGFPEEIGNLTNLIGIY<br>LGGNKLNGSIPITLGKLQKLQGLHLEDNKLEGPIPDDICRETKLYELELSGNKLSGSIPACESNLASLGTLSLGSNKITS<br>IPLTIWNLKGMLYLNFSSNFFTGPLPLDIGNLKVLVGIDFSMNNFSDVIPTVIGGLINLQYLFLGYNRLQGSIPESEGDL<br>ISLKSLNLSNNNLSGSIPISLEKLSYLEDLDLSENKLKGEIPKGGSFGNFSAESFEGNELLCGSPNLQVPPCKTSIHHKS<br>RKNVLLLGIVLPLSTIFIIVVILLIVRYRKRVKQPPNDANMPPIATCRRFSYLELCRATDRESENNLIGRGGFGSVYKAR<br>IGEGMEVAVKVEDLQCGRAFKSFDVECEIMKSIRHRNLIKVISSCSTEEFKVLVLEYMPHGSLEKNLYSSNCILDIFQRD<br>NIMVDVATALEYLHFGYSAPVIHCDLKPSNVLLDDNMVAHLSDFGIAKLLIGEDQSMTQTQTLATIGYMAPEYGREGRIS<br>TNGDVYSEGIILMETFTGKKPTDEIFNEEMTLKHWVNDWLPISIMKVIDANLLSWEDIHFVAKEQCVSFVENLAMECTVE<br>SPQQRINAKEIVTRLLKIRDSLLRNVGGRCIRQSNLN |
| >KDO48988.1 hypothetical protein CISIN_1g036229mg [*Citrus sinensis*]<br>(SEQ ID NO: 387)<br>MERVHSLSMMSRFLFLHCLILISLLTAAATANTSSITTDQDALLALKAHITHDPINFLAKNWNTSTPVCNWTGVTCDVHS<br>HRVKVLNISHLNLTGTIPSQLWNLSSLQSENLGENRESGSIPSAIFTLYTLKYVNERGNQLSGAFPSFIENKSSLQHLDF<br>SYNALSGEIPANICSNLPFLESISLSQNMFHGRIPSALSNCKYLEILSLSINNLLGAIPKEIGNLTKLKELYLGYSGLQG<br>EIPREFGNLAELELMALQVSNLQGEIPQELANLTGLEVLKLGKNFLTGEIPPEIHNLANLKLLDLSHNKLVGAVPATIEN<br>MSTLTGLGLQSNSLSGSLSSIADVQLPNLEELRLWSNNFSGTIPRFIFNASKLSVLELGRNSFSGFIPNTEGNLRNLRLM<br>TLHYNYLTSSNLELSFLSSFSNCKSLTYIGLSNNPLDGILPRMSMGNLSHSLEYFDMSYCNVSGGFPKEIGNLTNLIGIY<br>LGGNKLNGSIPITLGKLQKLQGLHLEDNKLEGPIPDDICRLTKLYELGLSGNKLSGSIPACFSNLASLGTLSLGSNKLTS<br>IPLTIWNLKGMLYLNFSSNFFTGPLPLDIGNLKVLIGIDESTNNFSDVIPTVIGGLINLQYLFLGYNRLQGSISESFGDL<br>ISLKSINLSNNNLSRSIPISLEKLSYLEDLDLSENKLKGEIPKGGSFGNESAKSFEGNELLCGSPNLQVPPCKTSIHHKS<br>RKNVLLLGIVLPLSTIFIIVVILLIVRYRKRVKQPPNDANMPPIATCRRFSYLELCRATNRFSENNLIGRGGFGSVYKAR<br>IGEGMEVAVKVEDLQCGRAFKSFDVECEMMKSIRHRNLIKVISSCSTEEFKALILEYMPHGSLEKSLYSSNYILDIFQRL<br>NIMVDVATTLEYLHFGYSAPVIHCDLKPSNVLLDDNMVAHLSDFGIAKLLIGEDQSITQTQTLATIGYMAPGLFHVKYIL<br>FVVNFLTSYSFLMIFIGRGNYY |
| >XP_024953043.1 probable LRR receptor-like serine/threonine-protein kinase<br>At3g47570 isoform X8 [*Citrus sinensis*]<br>(SEQ ID NO: 388)<br>MERLHSLRMMSRELLLHCLILISLFIAAATANTSSTITDRDALLALKAHITHDPINFLAKNWNTSTPVCNWTGVACDVHS<br>HRVTVLNISSLNETGTIPSQLGNLSSLQSLNLSCNRLEGSIPSAIFTIYTLKYVSLRENQVSGQIPANICSNLPFLDYLS<br>LGKNMFHGGIPSALSNCTYLQILHLSYNDESGAVPKDIGNLSKLKELYLGRNRLQGEIPREFVNITELERMSLSENELQG<br>GIPRELGNLTKLEGLQLFRNNLTGGIPRELGNLTKLERLQLFWNNLTGAIPKEIGNLTKLKELSLDGNRLQGEIPLEISN<br>LQNLEELDLRHNKLVDVRLPNLEALLLWDNPLDGILSKTSIGGNKLNGSIPITLSKLQKLQGLGLDDNKLEGSIPDSICR<br>LTELYELELGGNKLEGSIPACFSNLASLRILSLSSNELTSIPLTEWNLKDILQLNESSNFLTGPLPLEIGNLKVLIGIDE<br>SMNNFSSVIPTEIGGLKNLEYLFLGYNRLEGSIPDSEGDLISLKFLNLSNNNLSGAIPTSLEKLSYLEDLNLSENKLEGE<br>IPRGGSEGNFAAESFEGNELLCGSPTLQVLPCKTSIHHTSWKNSLLLGIVEPLSTTLLIVVIWLILRYRKRGKQPSNDAN<br>MPLVATWRTFSYLELCRATNGFSENNLIGRGGFGSVYKARLGDGMEVAVKVENLQCGRAFKSFAVECEMMKSIRHRNLIK<br>VISSCSNEEFKALVLEYKPHGSLEKYLYSSNCILDIFQRLNIMIDVASALEYLHFGCSAPVIHCDLKPDNVLLDDNLVAY<br>LSDFGIAKLLIGEDQSMTQTQTLATIGYMAPEYGREGRVSINGDVYSFGIMLMETETGKKPTDEIENGEMTLKHWVNDWL<br>PISTMEVVDANLLSQEDVHFVAKEQCVSFVENLAMACTVESHEQRINAKEIVTKLLKIRDSLLRNVGGRRISQPNLN |

SEQUENCE LISTING (388 sequences)

SEQ ID NO: 1 - protein, 641 aa, Citrus clementina
MALVSASTERINLCGPTDPSSSRSTSEATSSANVSCAADPPDRNVQFSTSPIPNGDVEVQSSVTLRSEEYRQLFRLPSEEVLVQDFNCAFQESILLQGHMYLFVHFICFYSNIFGFETKKIIPFYEVTAVRRAKTAGIFPNAIEIFAAGKKYFFASFLSRDEAFKLITDGWLQHGSGSLASAEQQDSSSETSSPQNGPVVIEKVNCCSADPIAKSDSIIREEDLSSDSKLPANVEMTPVEMQDDNVEQDFEPVLDTDSLHPIKTSSWNIENSDAPKIPECYTKVAETNFQMKVEDFYSLFFSDDTVNFIESFHRKCGDKEFKCTSWHRHYEFGYSRDLSFQHPIKVYFGAKFGSCKETQKFRVYRNSHLVIETSQEVHDVPYGDYFRVEGLWDVMRDDGGSKEGCILRVYVNVAFSKKTVWKGKIVQSTLEECRDVYAMWIGMAHDVLKQKNLEKPEEGGPAYSTVQNDDVHSERVVNTGETSERLCNADHRIRTLPITDSLDASQSVGNLLQGNLVDSAAIASLLRESMTKCCSFVKRQSGVSLILVIAFAVIFLMQVSILVLLNRPQHVHMASPPDYMGAGVGVGLGQRSAESIPWLERRMHYLKDEMLMVEARLERMWHEHAVLRAQLKDIEQLHKRE

SEQ ID NO: 2 - protein, 641 aa, Citrus sinensis; identical to SEQ ID NO: 1

SEQ ID NO: 3 - protein, 648 aa, Citrus sinensis
MALVSASTERINLCGPTDPSSSRSTSEATSSANVSCAADPPDRNVQFSTSPIPNGDVEVQSSVTLRSEEYRQLFRLPSEEVLVQDFNCAFQESILLQGHMYLFVHFICFYSNIFGFETKKIIPFYEVTAVRRAKTAGIFPNAIEIFAAGKKYFFASFLSRDEAFKLITDGWLQHGSGSLASAEQQDSSSETSSPQNGPVVIEKVNCCSADPIAKSDSIIREEDLSSDSKLPANVEMTPVEMQDDNVEQDFEPVLDTDSLHPIKTSSWNIENSDAPKIPECYTKVAETNFQMKVEDFYSLFFSDDTVNFIESFHRKCGDKEFKCTSWHRHYEFGYSRDLSFQHPIKVYFGAKFGSCKETQKFRVYRNSHLVIETSQEVHDVPYGDYFRVEGLWDVMRDDGGSKEGCILRVYVNVAFSKKTVWKGKIVQSTLEECRDVYAMWIGMAHDVLKQKNLEKPEGWIVVDSEGGPAYSTVQNDDVHSERVVNTGETSERLCNADHRIRTLPITDSLDASQSVGNLLQGNLVDSAAIASLLRESMTKCCSFVKRQSGVSLILVIAFAVIFLMQVSILVLLNRPQHVHMASPPDYMGAGVGVGLGQRSAESIPWLERRMHYLKDEMLMVEARLERMWHEHAVLRAQLKDIEQLHKRE

SEQ ID NO: 4 - protein, 573 aa, Citrus sinensis
MYLFVHFICFYSNIFGFETKVTSKFQCYVASCNSTLQYQSCFAISNEFMLQKIIPFYEVTAVRRAKTAGIFPNAIEIFAAGKKYFFASFLSRDEAFKLITDGWLQHGSGSLASAEQQDSSSETSSPQNGPVVIEKVNCCSADPIAKSDSIIREEDLSSDSKLPANVEMTPVEMQDDNVEQDFEPVLDTDSLHPIKTSSWNIENSDAPKIPECYTKVAETNFQMKVEDFYSLFFSDDTVNFIESFHRKCGDKEFKCTSWHRHYEFGYSRDLSFQHPIKVYFGAKFGSCKETQKFRVYRNSHLVIETSQEVHDVPYGDYFRVEGLWDVMRDDGGSKEGCILRVYVNVAFSKKTVWKGKIVQSTLEECRDVYAMWIGMAHDVLKQKNLEKPEEGGPAYSTVQNDDVHSERVVNTGETSERLCNADHRIRTLPITDSLDASQSVGNLLQGNLVDSAAIASLLRESMTKCCSFVKRQSGVSLILVIAFAVIFLMQVSILVLLNRPQHVHMASPPDYMGAGVGVGLGQRSAESIPWLERRMHYLKDEMLMVEARLERMWHEHAVLRAQLKDIEQLHKRE

SEQ ID NO: 5 - protein, 442 aa, Citrus sinensis
MALVSASTERINLCGPTDPSSSRSTSEATSSANVSCAADPPDRNVQFSTSPIPNGDVEVQSSVTLRSEEYRQLFRLPSEEVLVQDFNCAFQESILLQGHMYLFVHFICFYSNIFGFETKKIIPFYEVTAVRRAKTAGIFPNAIEIFAAGKKYFFASFLSRDEAFKLITDGWLQHGSGSLASAEQQDSSSETSSPQNGPVVIEKVNCCSADPIAKSDSIIREEDLSSDSKLPANVEMTPVEMQDDNVEQDFEPVLDTDSLHPIKTSSWNIENSDAPKIPECYTKVAETNFQMKVEDFYSLFFSDDTVNFIESFHRKCGDKEFKCTSWHRHYEFGYSRDLSFQHPIKVYFGAKFGSCKETQKFRVYRNSHLVIETSQEVHDVPYGDYFRVEGLWDVMRDDGGSKEGCILRVYVNVAFSKKTVWKGLPLLIHLLISPTCRVLLHV

SEQ ID NO: 6 - protein, 589 aa, Atalantia buxifolia
MSSATLRSEEYRQLFRLPSEEVLVQDFNCAFQESILLQGHMYLFVHFICFYSNIFGFETKKIIPFCEVTAVRRAKTAGIFPNAIEIFAAGKKYFFASFLSRDEAFKLITDGWLQHGSGSLASAEQQDSSSETSSPQNGPVVMEKVNCCSADPIAESDSIIREEDLSSDSKLPANVEMTPVEIQDDNVEQDFEPILDTDSSHPIKTSSWNIENSDAPKIPECYTKVAETKFQMKVEDFYSLFFSDDTVNFIESFHRKCGDKEFKCTLWHPHDEFGYSRDLSFQHPIKVYFGAKFGSCKETQKFRVYRNSHLVIETSQEVHDVPYGDYFHVEGLWDVMRDDGGSKEGCILRVYVNVAFSKKTVWKGKIVQSTVEECRDVYAIWIGMAHDVLKQKNLEKPEGWIVVDSEGGPACSTVQNDDVHSERVVNTGETSERLCNADHQIRTLPITDSLDASQSIGNLLQGNLVDSAAIASLLRESMTKCCSFVKRQSGVSLILVIAFAVIFLMQVSILVLLNRPQHVHMASPPDYMGAGVGVGVGQRSAESIPWLERRMHYLKDEMLMVEARLERMWHEHAVLRAQLKDIEQLHKRE

SEQ ID NO: 7 - protein, 641 aa, Citrus cavaleriei
MALVSASTERINLCGPTDPSSSRSTSEATSSANVSCAADPPDRNVQFSTSPIPNGDVEVQSSVALRSEEYRQLFRLPSEEVLVQDFNCAFQESILLQGHMYLFVHFICFYSNIFGFETKKIIPFYEVTAVRRAKTAGIFPNAIEIFAAGKKYFFASFLSRDEAFKLITDGWLQHGGGSLASAEQQDSSSETSSPQNGPVVIEKVNCCSADPIAESDSIIREEDLSSDSKLPANVEMTPVEMQDDNVEQDFEPVLDTDSSHPIKILSWNIENSDAPKIPECYTKVAETKFQMKVEDFYSLFFSDDTVNFIESFHRKCGDKEFKCTSWHQHDEFGYSRDLSFQHPIKVYFGAKFGSCKETQKFQVYRNSHLVIETSQEVHDVPYGDYFRVEGLWDVMRDDGGSKEGCILRVYVNVAFSKKTVWKGKIVQSTLEECRDVYAMWIGMAHDVLKQKNLEKPEEGGPACSTVQNDDVHSERLVNTGETSERLCNADHRIRTLPITDSLDASQSVGNLLQGNLVDSAAIASWLRESMTKCCSFVKRQSGVSLILVIAFAVIFLMQVSILVLLNRPQHVHMASPPDYMDAGVGLGLGQRSAESIPWLERRMHYLKDEMLMVEARLERMWHEHAVLRAQLKDMEQLHKRE

SEQ ID NO: 8 - protein, 612 aa, Citrus unshiu
MALVSASTERINLCGPTDPSSSRSTSEATSSANVSCAADPPDRNVQFSTSPIPNGDVEVQSSVTLRSEEYRQLFRLPSEEVLVQDFNCAFQESILLQGHMYLFVHFICFYSNIFGFETKKIIPFYEVTAVRRAKTAGIFPNAIEIFAAGKKYFFASFLSRDEAFKLITDGWLQHGSGSLASAEQQDSSSETSSPQNGPVVIEKVNCCSADPIAKSDSIIREEDLSSDSKLPANVEMTPVEMQDDNVEQDFEPVLDTDSLHPIKTSSWNIENSDAPKIPECYTKVAETNFQMKVEDFYSLFFSDDTVNFIESFHRKCGDKGAKFGSCKETQKFRVYRNSHLVIETSQEVHDVPYGDYFRVEGLWDVMRDDGGSKEGCILRVYVNVAFSKKTVWKGKIVQSTLEECRDVYAMWIGMAHDVLKQKNLEKPEEGGPAYSTVQNDDVHSERVVNTGETSERLCNADHRIRTLPITDSLDASQSVGNLLQGNLVDSAAIASLLRESMTKCCSFVKRQSGVSLILVIAFAVIFLMQVSILVLLNRPQHVHMASPPDYMGAGVGVGLGQRSAESIPWLERRMHYLKDEMLMVEARLERMWHEHAVLRAQLKDIEQLHKRE

SEQ ID NO: 9 - protein, 619 aa, Citrus unshiu
MALVSASTERINLCGPTDPSSSRSTSEATSSANVSCAADPPDRNVQFSTSPIPNGDVEVQSSVTLRSEEYRQLFRLPSEEVLVQDFNCAFQESILLQGHMYLFVHFICFYSNIFGFETKKIIPFYEVTAVRRAKTAGIFPNAIEIFAAGKKYFFASFLSRDEAFKLITDGWLQHGSGSLASAEQQDSSSETSSPQNGPVVIEKVNCCSADPIAKSDSIIREEDLSSDSKLPANVEMTPVEMQDDNVEQDFEPVLDTDSLHPIKTSSWNIENSDAPKIPECYTKVAETNFQMKVEDFYSLFFSDDTVNFIESFHRKCGDKGAKFGSCKETQKFRVYRNSHLVIETSQEVHDVPYGDYFRVEGLWDVMRDDGGSKEGCILRVYVNVAFSKKTVWKGKIVQSTLEECRDVYAMWIGMAHDVLKQKNLEKPEGWIVVDSEGGPAYSTVQNDDVHSERVVNTGETSERLCNADHRIRTLPITDSLDASQSVGNLLQGNLVDSAAIASLLRESMTKCCSFVKRQSGVSLILVIAFAVIFLMQVSILVLLNRPQHVHMASPPDYMGAGVGVGLGQRSAESIPWLERRMHYLKDEMLMVEARLERMWHEHAVLRAQLKDIEQLHKRE

SEQ ID NO: 10 - protein, 641 aa, Citrus trifoliata
MALVSASTERINLCGPTDPSSSRSTSEATPSANVSCAADPPDRNVQFSTSPIPNGDVEVQSSVTLRSEEYRQLFRLPSEEVLVQDFNCAFQESILLQGHMYLFVHFICFYSNIFGFETKKIIPFCEVTAVRRAKTAGIFPNAIEIFAAGKKYFFASFLSRDEAFKLITDGWLQHGGGSLASAEQQDSSSETSSPQNGPVVIEKVNCCSADPIAESDSIIREEDLSSDSKLPANVEMTPVEMQDDNVEQDFEPVLDTDSSHPINISSWNIENSDAPKIPECYTKVAETKFQMKVEDFYSLFFSDDTVNFIESFHRKCGDKEFKCTSWHRHDEFGYSRDLSFQHPIKVYFGAKFGSCKETQKFRVYRNSHLVIETSQEVHDVPYGDYFRVEGLWYVMRDDGGSKEGCILRVYVNVAFSKKTVWKGKILQSTLEECRDVYAMWIGMAHDVLKQKNLEKPEEGGPACSTVQNDDVHSERVVNTGETSERLCDADHRIRTLPITDSLDASQSVGNLLQGNLVDSAAIASWLRESMTKCCSFVKRQSGVSLILVIAFAVIFLMQVSILVLLNRPQHVHMASPPDYMGAGVGVGLGQRSAESIPWLERRMHYLKDEMLMVEARLERMWHEHAVLRAQLKDMEQLHKRE

SEQ ID NO: 11 - protein, 633 aa, Solanum lycopersicum
MAAVVVPEKIMSPSPPPSQHMHLSPPTSRRSTDTSSGTNASPDRRSSLDLPSSSTSSPSRLSDAQNQLALKSEEYRLLFRLPPDEVLVQDFNCALQENFLLQGHMYLFVHSICFYSNLFGFETKKIIPFHEITAVRRAKAAAIFPTAIEIVAGGKKYFFTSFLSRDEAFKLIDDGWLQHNGAAKESADLEPQSDLTFLDSGIVEGADSFRQATERVECLERNEDNMVQEDSKPLVNGQFEIVSNPSRVQDNVEEEVVIVQNTDCSPSEKSYGLKQEDSDAPRVPEGFTLVAEAKFPVTVEKFFELFISDAGVAFQESFRRNCGDKDFKCTQWRPHEEFGHTRNLSFQHPIKIYLGPKFGGCHEFQKCRRYRNSHLVIESSQEISGVPFADYFRVEAFWDVERDGDGPEGGCIMKVYLNLVFTKKTIFRGKIVQSTIDECRALYVKWIALARELLKQKKLEKEKADCLAANVVTSAQPKESYEHVENIVETSKEIRSQIPPLNQQAADSSTVSLTSSCRDFMLKCSASLKSQSHVSILIVITIAVILILMQMSILVLLGRPQHVQVISQGDSASSMYRLGETGVDILGFLDKKINHLKDEMFMVETLLGKMQQEHTLLKTQLKEFEHLRKLQKG

SEQ ID NO: 12 - protein, 634 aa, Solanum tuberosum
MAAVVVPEKIMSPSPPPSQHMHTSPSTSRRSMDTASDTNASPDRRSSLDLPSSSTASPSRLSDAQNQLALKSEEYRLLFRLPPDEVLVQDFNCALQESFLLQGHMYLFGHSICFYSNLFGFETKKIIPFHEITAVRRAKAAAIFPTAIEIVAGGKKYFFTSFLSRDEAFKLIDDGWLQHNGAAKESADLEPQSDLNFLDSGIVEGADSFRQAKEGVECLERNEDNMVQEDSKPLVNGQFEIVSNPSGVQDSVEEEAVIVQNTDCSSSEKSYGLKQEDSDAPRVPEGFTLVAEAKFPVKVEKFFEFFISDAGLAFQESFRRKCGDKDFKCTQWRPHEEFGHTRNLSFQHPIKIYLGPKFGGCHEFQKCRHYRNSHLVIESSQEITGVPYADYFRVEAFWDVERDGDGPEGGCCMKVYLNVVFTKKTIFRGKIVQSTIDECRALYVTWIALAHDELLKQKKLEKEKADGQAAIVVTSAQPKKIYEHVENLDETSNEIRSQIPPLNQQAADSSTVSITSLCRDFMLKCSSSLKSQSHVSILIVITIAVILILMQMSILVLLGRPQHVQVISQGDSASSMYRLGETGVDILGFLDKKINHLKDEMFMVETLLGKMQQEHTLLKTQLKEFEHLRKLQKG

SEQ ID NO: 13 - protein, 1906 aa, Citrus trifoliata
MEIDSPPDFSPPKPRDRIVRRLINIGVPEEFLDYSGIVNFAKNDKSRIPELVSTILPPDEEVAEVIQDAKAKNKKVSVGPNMKGRFRESMLWLQCLMFEREPEKVLRKLSKIGQRAYRCRTCEHDPTCAICVPCFQNGNHKEHDYSIIYTGGGCCDCGDVTAWKREGFCSRHKGAEQIQPLPEKYANSATPVLDALFIYWENKLSLAESVGQENPRSSDHVAERRKLANELTFAVVEMLLEFCKNSESLLSFVSKRVISVIGLLDILVRAERFSSDVVVKNLHELLLKLLGEPIFKYEFAKVFLSYYPVFVKDAIREHSDDTIKKYPLLSTFSVQIFTVPTLTPRLVKEMNLLEMLLGCLREIFDSCAGDDSCIQVAKGANLYETTNRVIGDIRFVMSHAAVSKYATHEQLNISKAWMKLLTFVQGMNPQKRETGIQIREENEYMHLPLVLDHSIANIQPLLVDGAFSSAVAEETRYDFSMYKQDIGDGDSLRHAKVGRLSQESSVCGAMGRSSLSASTLKADDVIFDAVSDVLLPHSVTWLAHECLRAMENWLGVDDRSVSVNDILSPNASRISGSNFVALKKTLSKIKKGKSIFSRLAGTSEVTASIQESGDLDNATSMGKESKITISGERGTASWRSAGFNDSQMEGECAAELDNLHVLSLCYWPDITYDVSSQDVSVHIPLHRLLSLIIQKALRRCYGESAASESADTGAENPLSAVSLDFFGHILGGCHPYGFSAFVMEHPLRIRVFCAQVHAGMWRRNGDAALSSCEWYRAVRWSEQGLELDLFLLQCCAALAPADLYVNRIIERFGLSNYLSLNLERRSEYEPILVQEMLTLIIQILQERRFCGLTTAESLKRELVHRLAIGDATHSQLVKSLPRDLSKFDQLQEILDAVAMYSHPSGFNQVLLTALHLLALALDVCFQKKKSGDQSCDIGGSTPLLDFASEEIAEGLNNDNFLEAGNCNLSSVIESLLKKFAEIDSRCMTKLQQLAPEIVSHLSQSLPRDDTSGSFSASDSEKRKAKARERQAAILEKMKAEQFKFLSSISSNIEDAPKSAPEVTNYDAEHVSEESVQDVCALCHDPNSRTPVSYLILLQKSRLLSFVDRGSPSWDQDQWLGKECGTISANNMVNQFGTNTPSSGLGVISSCQLAQVAEEAVNQFAYNGKPEEVNAVLEFVKAQFPSLRNIPIPFTFSNGRKCTASSMEMFEQDLYLSICREMRKNMTYPDLMKEDEECSVAEGGFKNRGNSDSFLLGKYVASISKEMRENASASEVSRGDRIAAESLVYDGFGPIDCDGIHLSSCGHAVHQGCLDRYVSSLKERQFSLRNAAASINLPAAVMCFVCLYACIYNRRIIFEGGHIVDPDEGEFLCPVCRQLANSVLPALPWDLQRINEQPTVSGVGLEENTSLQLQQAVSLLLSASNVVGKADVIESFPLMKNEIMASNVEAVSRRMCKMYFQNKVDKFFGSARVNPSLIMWDALKYSLMSMEIAARSEKTSMTPIYDVNALDKELRSSSGFVLSLLLKVVQSMRSKNSLHVLQRFRGIQLFAESICSGTSIDNPGGRCKRGGNMLSILKHADVEVSYPDIQFWNRASDPVLARDPFSSLMWVLFCLPCQFILCKESLLSLVHVFYAVTLSQAVLSCCGKLQSKVNELGFSDSLISDISKLLGEFGSAQEYFVSNYIDPSCDIKDMIRRLSFPYLRRDHVLARSSHGISDMMDSSDDALSDLKEIQEVEKMFKIPSLDVILKDEVLRSLVLKWFHHFSKEFEVHRFQHVLYSTPAVPFKLMRLPHLYQDLLQRLCSPRWKPCCRESSCQSHAMACGAGTGVFLLIRRTTILLQRCARQAPWPSPYLDAFGEEDIEMHRGKPLYLNEERYAALTYMVASHGLDRSSKVLSQTTIGGFFLV

SEQ ID NO: 14 - protein, 1961 aa, Citrus clementina
MEIDSPPDFSPPKPRDRIVRRLINIGVPEEFLDYSGIVNFAKNDKSRIPELVSTILPPDEEVAEVIQDAKAKNKKVSVGPNMKGRFRESMLWLQWLMFEREPEKVLRKLSKIGQRGVCGAVWGNNDIAYRCRTCEHDPTCAICVPCFQNGNHKEHDYSIIYTGGGCCDCGDVTAWKREGFCSRHKGAEQIQPLPEKYANSAAPVLDALFIYWENKLSLAESVGQENPRASDHVAERRKLANELTFAVVEMLLEFCKNSESLLSFVSKRVISVIGLLDILVRAERFSSDVVVRKLHELLLKLLGEPIFKYEFAKVFLSYYPVFVKDAIREHSDDTIKKYPLLSTFSVQIFTVPTLTPRLVKEMNLLEMLLGCLREIFDSCAGDDSCLQVAKWANLYETTNRVIGDIRFVMSHAAVSKYATHEQLNISKAWMKLLTFVQGMNPQKRETGIHIREENEYMHLPLVLDHSIANIQPLLVDGAFSSAVAEETRYDFSMYKQDIGDGDSLRHAKVGRLSQESSVCGAMGRSSLSASTLKADDVIFDAVSDVLLPHSVTWLAHECLRAMENWLGVDDRSVSVNDILSPNASRISGSNFVALKKTLSKIKKGKSIFSRLAGSSEVTAGIQESGDLDNATSMGKESKITISGERDTASWRSAGFNDSEMEGECATELDNLHVLSLCYWPDITYDVSSQDVSVHIPLHRLLSLIIQKALRRCYGESAASESADTGAENPLSAVSLDFFGHILGGCHPYGFSAFVMEHPLRIRVFCAQVHAGMWRRNGDAALSSCEWYRAVRWSEQGLELDLFLLQCCAALAPADLYVNRIIERFGLSNYLSLNLERPSEYEPILVQEMLTLIIQILQERRFCGLTTAESLKRELVHRLAIGDATHSQLVKSLPRDLSKFDQLQEILDAVAMYSHPSGFNQLAITTCKSKVVLQVIRAVLFYAVFTDNPTDSRAPYGVLLTALHLLALALDVCFQKKKSGDQSCDIGGSTPILDFASEEIAEGLNNGAGKQSLLSLLVFLMGMYKKDGADNFLEAGNCNLSSVIESLLKKFAEIDSRCMTKLQQLAPEIVSHLSQSLPRDDTSGSFSASDSEKRKAKARERQAAILEKMKAEQFKFLSSISSNIEDAPKSAPEVTNYDAEHVSEESVQDVCALCHDPNSRTPVSYLILLQKSRLLSFVDRGSPSWDQDQWLGKECGTISANNMVNQFGTNTPSSALGVISSCQLAQVAEEAVNQFAYNGKPEEVNAVLEFVKAQFPSLRNIPIPFTFSNGRKCTASSMEMFEQDLYLSICREMRKNMTYPDLMKEDEECSVAEGGLKNRGNSDSFLLGKYVASISKEMRENASASEVSRGDRIAAESLVYDGFGPIDCDGIHLSSCGHAVHQGCLDRYVSSLKERYNRRIIFEGGHIVDPDQGEFLCPVCRQLANSVLPALPWDLQRINEQPTVSGVGLSLDSNSSFTTREENTSLQLQQAVSLLQSASNVVGKADVIESFPLLKNEIMASNVEAVSRRMCKMYFQNKLDKFFGSARVNPSLIMWDALKYSLMSMEIAARSEKTSTTPIYDVNALDKELKSSSGFVLSLLLKVVQSMRSKNSLHVLQRFRGIQLFAESICSGTSIDNPGGRCKRGGNMLSILKHADVEVSYPDIQFWNRASDPVLARDPFSSLMWVLFCLPCQFILCKESLLSLVHVFYAVTLSQAVLSCCGKLQSKVNELGFSDSLISDISKLLGEFGSAQEYFVSNYIDPSCDIKDMIRRLSFPYLRRDHVLARSSHGISDMMDSSDDALSDLKEIQEVEKMFKIPSLDVILKDEVLRSLVLKWFHHFSKEFEVHRFQHVLYSTPAVPFKLMCLPHLYQDLLQRLCSPSWKPCCRESSCQSHAVACGAGTGVFLLIRRTTILLQRCARQAPWPSPYLDAFGEEDIEMHRGKPLYLNEERYAALTYMVASHGLDRSSKVLSQTTIGGFFLV

SEQ ID NO: 15 - protein, 2060 aa, Citrus sinensis
MEIDSPPDFSPPKPRDRIVRRLINIGVPEEFLDYSGIVNFAKNDKSRIPELVSTILPPDEEVAEVIQDAKAKNKKVSVGPNMKGRFRESMLWLQWLMFEREPEKVLRKLSKIGQRGVCGAVWGNNDIAYRCRTCEHDPTCAICVPCFQNGNHKEHDYSIIYTGGGCCDCGDVTAWKREGFCSRHKGAEQIQPLPEKYANSAAPVLDALFIYWENKLSLAESVGQENPRASDHVAERRKLANELTFAVVEMLLEFCKNSESLLSFVSKRVISVIGLLDILVRAERFSSDVVVRKLHELLLKLLGEPIFKYEFAKVFLSYYPVFVKDAIREHSDDTIKKYPLLSTFSVQIFTVPTLTPRLVKEMNLLEMLLGCLREIFDSCAGDDSCLQVAKWANLYETTNRVIGDIRFVMSHAAVSKYATHEQLNISKAWMKLLTFVQGMNPQKRETGIHIREENEYMHLPLVLDHSIANIQPLLVDGAFSSAVAEETRYDFSMYKQDIGDGDSLRHAKVGRLSQESSVCGAMGRSSLSASTLKADDVIFDAVSDVLLPHSVTWLAHECLRAMENWLGVDDRSVSVNDILSPNASRISGSNFVALKKTLSKIKKGKSIFSRLAGSSEVTAGIQESGDLDNATSMGKESKITISGERDTASWRSAGFNDSEMEGECATELDNLHVLSLCYWPDITYDVSSQDVSVHIPLHRLLSLIIQKALRRCYGESAASESADTGAENPLSAVSLDFFGHILGGCHPYGFSAFVMEHPLRIRVFCAQVHAGMWRRNGDAALSSCEWYRAVRWSEQGLELDLFLLQCCAALAPADLYVNRIIERFGLSNYLSLNLERPSEYEPILVQEMLTLIIQILQERRFCGLTTAESLKRELVHRLAIGDATHSQLVKSLPRDLSKFDQLQEILDAVAMYSHPSGFNQGMYSLRWSYWKELDIYHPRWSSRDLQVAEERYLRFCSVSALTAQLPRWTKIYYPLESIAGIATCKVVLQVIRAVLFYAVFTDNPTDSRAPYGVLLTALHLLALALDVCFQKKKSGDQSCDIGGSTPILDFASEEIAEGLNNGAGKQSLLSLLVFLMGMYKKDGADNFLEAGNCNLSSVIESLLKKFAEIDSRCMTKLQQLAPEIVSHLSQSLPRDDTSGSFSASDSEKRKAKARERQAAILEKMKAEQFKFLSSISSNIEDAPKSAPEVTNYDAEHVSEESVQDVCALCHDPNSRTPVSYLILLQKSRLLSFVDRGSPSWDQDQWLGKECGTISANNMVNQFGTNTPSSALGVISSCQLAQVAEEAVNQFAYNGKPEEVNAVLEFVKAQFPSLRNIPIPFTFSNGRKCTASSMEMFEQDLYLSICREMRKNMTYPDLMKEDEECSVAEGGLKNRGNSDSFLLGKYVASISKEMRENASASEVSRGDRIAAESLVYDGFGPIDCDGIHLSSCGHAVHQGCLDRYVSSLKERYNRRIIFEGGHIVDPDQGEFLCPVCRQLANSVLPALPWDLQRINEQPTVSGVGLSLDSNSSFTTREENTSLQLQQAVSLLQSASNVVGKADVIESFPLLKNEIMASNVEAVSRRMCKMYFQNKLDKFFGSARVNPSLIMWDALKYSLMSMEIAARSEKTSTTPIYDVNALDKELKSSSGFVLSLLLKVVQSMRSKNSLHVLQRFRGIQLFAESICSGTSIDNPGGRCKRGGNMLSILKHADVEVSYPDIQFWNRASDPVLARDPFSSLMWVLFCLPCQFILCKESLLSLVHVFYAVTLSQAVLSCCGKLQSKVNELGFSDSLISDISKLLGEFGSAQEYFVSNYIDPSCDIKDMIRRLSFPYLRRCALLWKLLNSTVPPPFSDRDHVLARSSHGISDMMDSSDDALSDLKEIQEVEKMFKIPSLDVILKDEVLRSLVLKWFHHFSKEFEVHRFQHVLYSTPAVPFKLMCLPHLYQDLLQRYIKQCCSDCKSVLDEPALCLLCGRLCSPSWKPCCRESSCQSHAVACGAGTGVFLLIRRTTILLQRCARQAPWPSPYLDAFGEEDIEMHRGKPLYLNEERYAALTYMVASHGLDRSSKVLSQTTIGGFFLV

SEQ ID NO: 16 - protein, 2057 aa, Citrus sinensis
MEIDSPPDFSPPKPRDRIVRRLINIGVPEEFLDYSGIVNFAKNDKSRIPELVSTILPPDEEVAEVIQDAKAKNKKVSVGPNMKGRFRESMLWLQWLMFEREPEKVLRKLSKIGQRGVCGAVWGNNDIAYRCRTCEHDPTCAICVPCFQNGNHKEHDYSIIYTGGGCCDCGDVTAWKREGFCSRHKGAEQIQPLPEKYANSAAPVLDALFIYWENKLSLAESVGQENPRASDHVAERRKLANELTFAVVEMLLEFCKNSESLLSFVSKRVISVIGLLDILVRAERFSSDVVVRKLHELLLKLLGEPIFKYEFAKVFLSYYPVFVKDAIREHSDDTIKKYPLLSTFSVQIFTVPTLTPRLVKEMNLLEMLLGCLREIFDSCAGDDSCLQVAKWANLYETTNRVIGDIRFVMSHAAVSKYATHEQLNISKAWMKLLTFVQGMNPQKRETGIHIREENEYMHLPLVLDHSIANIQPLLVDGAFSSAVAEETRYDFSMYKQDIGDGDSLRHAKVGRLSQESSVCGAMGRSSLSASTLKADDVIFDAVSDVLLPHSVTWLAHECLRAMENWLGVDDRSVSVNDILSPNASRISGSNFVALKKTLSKIKKGKSIFSRLAGSSEVTAGIQESGDLDNATSMGKESKITISGERDTASWRSAGFNDSEMEGECATELDNLHVLSLCYWPDITYDVSSQDVSVHIPLHRLLSLIIQKALRRCYGESAASESADTGAENPLSAVSLDFFGHILGGCHPYGFSAFVMEHPLRIRVFCAQVHAGMWRRNGDAALSSCEWYRAVRWSEQGLELDLFLLQCCAALAPADLYVNRIIERFGLSNYLSLNLERPSEYEPILVQEMLTLIIQILQERRFCGLTTAESLKRELVHRLAIGDATHSQLVKSLPRDLSKFDQLQEILDAVAMYSHPSGFNQGMYSLRWSYWKELDIYHPRWSSRDLQVAEERYLRFCSVSALTAQLPRWTKIYYPLESIAGIATCKVVLQVIRAVLFYAVFTDNPTDSRAPYGVLLTALHLLALALDVCFQKKKSGDQSCDIGGSTPILDFASEEIAEGLNNGAGKQSLLSLLVFLMGMYKKDGADNFLEAGNCNLSSVIESLLKKFAEIDSRCMTKLQQLAPEIVSHLSQSLPRDDTSGSFSASDSEKRKAKARERQAAILEKMKAEQFKFLSSISSNIEDAPKSAPEVTNYDAEHVSEESVQDVCALCHDPNSRTPVSYLILLQKSRLLSFVDRGSPSWDQDQWLGKECGTISANNMVNQFGTNTPSSALGVISSCQLAQVAEEAVNQFAYNGKPEEVNAVLEFVKAQFPSLRNIPIPFTFSNGRKCTASSMEMFEQDLYLSICREMRKNMTYPDLMKEDEECSVAEGGLKNRGNSDSFLLGKYVASISKEMRENASASEVSRGDRIAAESLVYDGFGPIDCDGIHLSSCGHAVHQGCLDRYVSSLKERYNRRIIFEGGHIVDPDQGEFLCPVCRQLANSVLPALPWDLQRINEQPTVSGVGLSLDSNSSFTTREENTSLQLQQAVSLLQSASNVVGKADVIESFPLLKNEIMASNVEAVSRRMCKMYFQNKLDKFFGSARVNPSLIMWDALKYSLMSMEIAARSEKTSTTPIYDVNALDKELKSSSGFVLSLLLKVVQSMRSKNSLHVLQRFRGIQLFAESICSGTSIDNPGGRCKRGGNMLSILKHADVEVSYPDIQFWNRASDPVLARDPFSSLMWVLFCLPCQFILCKESLLSLVHVFYAVTLSQAVLSCCGKLQSKVNELGFSDSLISDISKLLGEFGSAQEYFVSNYIDPSCDIKDMIRRLSFPYLRRCALLWKLLNSTVPPPFSDRDHVLARSSHGISDMMDSSDDALSDLKEIQEVEKMFKIPSLDVILKDEVLRSLVLKWFHHFSKEFEVHRFQHVLYSTPAVPFKLMCLPHLYQDLLQRYIKQCCSDCKSVLDEPALCLLCGRLCSPSWKPCCSCQSHAVACGAGTGVFLLIRRTTILLQRCARQAPWPSPYLDAFGEEDIEMHRGKPLYLNEERYAALTYMVASHGLDRSSKVLSQTTIGGFFLV

SEQ ID NO: 17 - protein, 2060 aa, Citrus sinensis
MEIDSPPDFSPPKPRDRIVRRLMNIGVPEEFLDYSGIVNFAKNDKSRIPELVSTILPPDEEVAEVIQDAKAKNKKVSVGPNMKGRFRESMLWLQWLMFEREPEKVLRKLSKIGQRGVCGAVWGNNDIAYRCRTCEHDPTCAICVPCFQNGNHKEHDYSIIYTGGGCCDCGDVTAWKREGFCSRHKGAEQIQPLPEKYANSAAPVLDALFIYWENKLSLAESVGQENPRASDHVAERRKLANELTFAVVEMLLEFCKNSESLLSFVSKRVISVIGLLDILVRAEMFSSDVVVRKLHELLLKLLGEPIFKYEFAKVFLSYYPVFVKDAIREHSDDTIKKYPLLSTFSVQIFTVPTLTPRLVKEMNLLEMLLGCLREIFDSCAGDDSCLQVAKWANLYETTNRVIGDIRFVMSHAAVSKYATHEQLNISKAWMKLLTFVQGMNPQKRETGIHIREENEYMHLPLVLDHSIANIQPLLVDGAFSSAVSEETRYDFSMYKQDIGDGDSLRHAKVGRLSQESSVCGAMGRSSLSASTLKADDVIFDAVSDVLLPHSVTWVAHECLRAMENWLGVDDRSVSVNDILSPNASRISGSNFVALKKTLSKIKKGKSIFSRLAGSSEVTAGIQESGDLDNATSMGKESKITISGERDTASWRSAGFNDSEMEGECATELDNLHVLSLCYWPDITYDVSSQDVSVHIPLHRLLSLIIQKALRRCYGESAASESADTGAENPLSAVSLDFFGHILGGCHPYGFSAFVMEHPLRIRVFCAQVHAGMWRRNGDAALSSCEWYRAVRWSEQGLELDLFLLQCCAALAPADLYVNRIIERFGLSNYLSLNLERPSEYEPILVQEMLTLIIQILQERRFCGLTTAESLKRELVHRLAIGDATHSQLVKSLPRDLSKFDQLQEILDAVAMYSHPSGFNQGMYSLRWSYWKELDIYHPRWSSRDLQVAEERYLRFCSVSALTAQLPRWTKIYYPLESIAGIATCKVVLQVIRAVLFYAVFTDNPTDSRAPYGVLLTALHLLALALDVCFQKKKSGDQSCDIGGSTPILDFASEEIAEGLNNGAGKQSLLSLLVFLMGMYKKDGADNFLEAGNCNLSSVIESLLKKFAEIDSRCMTKLQQLAPEIVSHLSQSLPRDDTSGSFSASDSEKRKAKARERQAAILEKMKAEQFKFLSSISSNIEDAPKSAPEVTNYDAEHVSEESVQDVCALCHDPNSRTPVSYLILLQKSRLLSFVDRGSPSWDQDQWLGKECGTISANNMVNQFGTNTPSSGLGVISSCQLAQVAEEAVNQFAYNGKPEEVNSVLEFVKAQFPSLRNIPIPFTFSNGRKCTASSMEMFEQDLYLSICREMRKNMTYPDLMKEDEECSVAEGGLKNRGNSDSFLLGKYVASISKEMRENASASEVSRGDRIAAESLVYDGFGPIDCDGIHLSSCGHAVHQGCLDRYVSSLKERYNRRIIFEGGHIVDPDQGEFLCPVCRQLANSVLPALPWDLQRINEQPTVSGVGLSLDSSSSFTTREENTSFQLQQAVSLLQSASNVVGKADVIESFPLMKNEIMASNVEAVSRRMCKMYFQNKLDKFFGSARVNPSLIMWDALKYSLMSMEIAARSEKTSTTPIYDVNALDKELKSSSGFVLSLLLKVVQSMRSKNSLHVLQRFRGIQLFAESICSGTSIDNPGGRCKRGGNMLSILKHADVEVSYPDIQFWNRASDPVLARDPFSSLMWVLFCLPCQFILCKESLLSLVHVFYAVTLSQAVLSCCGKLQSKVNELGFSDSLISDISKLLGEFGSAQEYFVSNYIDPSCDIKDMIRRLSFPYLRRCALLWKLLNSTVPPPFSDRDHVLARSSHGISDMMDSSDDALSDLKEIQEVEKMFKIPSLDVILKDEVLRSLVLKWFHHFSKEFEVHRFQHVLYSTPAVPFKLMCLPHLYQDLLQRYIKQCCSDCKSVLDEPALCLLCGRLCSPSWKPCCRESSCQSHAVACGAGTGVFLLIRRTTILLQRCARQAPWPSPYLDAFGEEDIEMHRGKPLYLNEERYAALTYMVASHGLDRSSKVLSQTTIGGFFLV

SEQ ID NO: 18 - protein, 2058 aa, Citrus sinensis
MEIDSPPDFSPPKPRDRIRLMNIGVPEEFLDYSGIVNFAKNDKSRIPELVSTILPPDEEVAEVIQDAKAKNKKVSVGPNMKGRFRESMLWLQWLMFEREPEKVLRKLSKIGQRGVCGAVWGNNDIAYRCRTCEHDPTCAICVPCFQNGNHKEHDYSIIYTGGGCCDCGDVTAWKREGFCSRHKGAEQIQPLPEKYANSAAPVLDALFIYWENKLSLAESVGQENPRASDHVAERRKLANELTFAVVEMLLEFCKNSESLLSFVSKRVISVIGLLDILVRAEMFSSDVVVRKLHELLLKLLGEPIFKYEFAKVFLSYYPVFVKDAIREHSDDTIKKYPLLSTFSVQIFTVPTLTPRLVKEMNLLEMLLGCLREIFDSCAGDDSCLQVAKWANLYETTNRVIGDIRFVMSHAAVSKYATHEQLNISKAWMKLLTFVQGMNPQKRETGIHIREENEYMHLPLVLDHSIANIQPLLVDGAFSSAVSEETRYDFSMYKQDIGDGDSLRHAKVGRLSQESSVCGAMGRSSLSASTLKADDVIFDAVSDVLLPHSVTWVAHECLRAMENWLGVDDRSVSVNDILSPNASRISGSNFVALKKTLSKIKKGKSIFSRLAGSSEVTAGIQESGDLDNATSMGKESKITISGERDTASWRSAGFNDSEMEGECATELDNLHVLSLCYWPDITYDVSSQDVSVHIPLHRLLSLIIQKALRRCYGESAASESADTGAENPLSAVSLDFFGHILGGCHPYGFSAFVMEHPLRIRVFCAQVHAGMWRRNGDAALSSCEWYRAVRWSEQGLELDLFLLQCCAALAPADLYVNRIIERFGLSNYLSLNLERPSEYEPILVQEMLTLIIQILQERRFCGLTTAESLKRELVHRLAIGDATHSQLVKSLPRDLSKFDQLQEILDAVAMYSHPSGFNQGMYSLRWSYWKELDIYHPRWSSRDLQVAEERYLRFCSVSALTAQLPRWTKIYYPLESIAGIATCKVVLQVIRAVLFYAVFTDNPTDSRAPYGVLLTALHLLALALDVCFQKKKSGDQSCDIGGSTPILDFASEEIAEGLNNGAGKQSLLSLLVFLMGMYKKDGADNFLEAGNCNLSSVIESLLKKFAEIDSRCMTKLQQLAPEIVSHLSQSLPRDDTSGSFSASDSEKRKAKARERQAAILEKMKAEQFKFLSSISSNIEDAPKSAPEVTNYDAEHVSEESVQDVCALCHDPNSRTPVSYLILLQKSRLLSFVDRGSPSWDQDQWLGKECGTISANNMVNQFGTNTPSSGLGVISSCQLAQVAEEAVNQFAYNGKPEEVNSVLEFVKAQFPSLRNIPIPFTFSNGRKCTASSMEMFEQDLYLSICREMRKNMTYPDLMKEDEECSVAEGGLKNRGNSDSFLLGKYVASISKEMRENASASEVSRGDRIAAESLVYDGFGPIDCDGIHLSSCGHAVHQGCLDRYVSSLKERYNRRIIFEGGHIVDPDQGEFLCPVCRQLANSVLPALPWDLQRINEQPTVSGVGLSLDSSSSFTTREENTSFQLQQAVSLLQSASNVVGKADVIESFPLMKNEIMASNVEAVSRRMCKMYFQNKLDKFFGSARVNPSLIMWDALKYSLMSMEIAARSEKTSTTPIYDVNALDKELKSSSGFVLSLLLKVVQSMRSKNSLHVLQRFRGIQLFAESICSGTSIDNPGGRCKRGGNMLSILKHADVEVSYPDIQFWNRASDPVLARDPFSSLMWVLFCLPCQFILCKESLLSLVHVFYAVTLSQAVLSCCGKLQSKVNELGFSDSLISDISKLLGEFGSAQEYFVSNYIDPSCDIKDMIRRLSFPYLRRCALLWKLLNSTVPPPFSDRDHVLARSSHGISDMMDSSDDALSDLKEIQEVEKMFKIPSLDVILKDEVLRSLVLKWFHHFSKEFEVHRFQHVLYSTPAVPFKLMCLPHLYQDLLQRYIKQCCSDCKSVLDEPALCLLCGRLCSPSWKPCCRESSCQSHAVACGAGTGVFLLIRRTTILLQRCARQAPWPSPYLDAFGEEDIEMHRGKPLYLNEERYAALTYMVASHGLDRSSKVLSQTTIGGFFLV

SEQ ID NO: 19 - protein, 2057 aa, Citrus sinensis
MEIDSPPDFSPPKPRDRIVRRLMNIGVPEEFLDYSGIVNFAKNDKSRIPELVSTILPPDEEVAEVIQDAKAKNKKVSVGPNMKGRFRESMLWLQWLMFEREPEKVLRKLSKIGQRGVCGAVWGNNDIAYRCRTCEHDPTCAICVPCFQNGNHKEHDYSIIYTGGGCCDCGDVTAWKREGFCSRHKGAEQIQPLPEKYANSAAPVLDALFIYWENKLSLAESVGQENPRASDHVAERRKLANELTFAVVEMLLEFCKNSESLLSFVSKRVISVIGLLDILVRAEMFSSDVVVRKLHELLLKLLGEPIFKYEFAKVFLSYYPVFVKDAIREHSDDTIKKYPLLSTFSVQIFTVPTLTPRLVKEMNLLEMLLGCLREIFDSCAGDDSCLQVAKWANLYETTNRVIGDIRFVMSHAAVSKYATHEQLNISKAWMKLLTFVQGMNPQKRETGIHIREENEYMHLPLVLDHSIANIQPLLVDGAFSSAVSEETRYDFSMYKQDIGDGDSLRHAKVGRLSQESSVCGAMGRSSLSASTLKADDVIFDAVSDVLLPHSVTWVAHECLRAMENWLGVDDRSVSVNDILSPNASRISGSNFVALKKTLSKIKKGKSIFSRLAGSSEVTAGIQESGDLDNATSMGKESKITISGERDTASWRSAGFNDSEMEGECATELDNLHVLSLCYWPDITYDVSSQDVSVHIPLHRLLSLIIQKALRRCYGESAASESADTGAENPLSAVSLDFFGHILGGCHPYGFSAFVMEHPLRIRVFCAQVHAGMWRRNGDAALSSCEWYRAVRWSEQGLELDLFLLQCCAALAPADLYVNRIIERFGLSNYLSLNLERPSEYEPILVQEMLTLIIQILQERRFCGLTTAESLKRELVHRLAIGDATHSQLVKSLPRDLSKFDQLQEILDAVAMYSHPSGFNQGMYSLRWSYWKELDIYHPRWSSRDLQVAEERYLRFCSVSALTAQLPRWTKIYYPLESIAGIATCKVVLQVIRAVLFYAVFTDNPTDSRAPYGVLLTALHLLALALDVCFQKKKSGDQSCDIGGSTPILDFASEEIAEGLNNGAGKQSLLSLLVFLMGMYKKDGADNFLEAGNCNLSSVIESLLKKFAEIDSRCMTKLQQLAPEIVSHLSQSLPRDDTSGSFSASDSEKRKAKARERQAAILEKMKAEQFKFLSSISSNIEDAPKSAPEVTNYDAEHVSEESVQDVCALCHDPNSRTPVSYLILLQKSRLLSFVDRGSPSWDQDQWLGKECGTISANNMVNQFGTNTPSSGLGVISSCQLAQVAEEAVNQFAYNGKPEEVNSVLEFVKAQFPSLRNIPIPFTFSNGRKCTASSMEMFEQDLYLSICREMRKNMTYPDLMKEDEECSVAEGGLKNRGNSDSFLLGKYVASISKEMRENASASEVSRGDRIAAESLVYDGFGPIDCDGIHLSSCGHAVHQGCLDRYVSSLKERYNRRIIFEGGHIVDPDQGEFLCPVCRQLANSVLPALPWDLQRINEQPTVSGVGLSLDSSSSFTTREENTSFQLQQAVSLLQSASNVVGKADVIESFPLMKNEIMASNVEAVSRRMCKMYFQNKLDKFFGSARVNPSLIMWDALKYSLMSMEIAARSEKTSTTPIYDVNALDKELKSSSGFVLSLLLKVVQSMRSKNSLHVLQRFRGIQLFAESICSGTSIDNPGGRCKRGGNMLSILKHADVEVSYPDIQFWNRASDPVLARDPFSSLMWVLFCLPCQFILCKESLLSLVHVFYAVTLSQAVLSCCGKLQSKVNELGFSDSLISDISKLLGEFGSAQEYFVSNYIDPSCDIKDMIRRLSFPYLRRCALLWKLLNSTVPPPFSDRDHVLARSSHGISDMMDSSDDALSDLKEIQEVEKMFKIPSLDVILKDEVLRSLVLKWFHHFSKEFEVHRFQHVLYSTPAVPFKLMCLPHLYQDLLQRYIKQCCSDCKSVLDEPALCLLCGRLCSPSWKPCCSCQSHAVACGAGTGVFLLIRRTTILLQRCARQAPWPSPYLDAFGEEDIEMHRGKPLYLNEERYAALTYMVASHGLDRSSKVLSQTTIGGFFLV

SEQ ID NO: 20 - protein, 2029 aa, Citrus sinensis
MEIDSPPDFSPPKPRDRIVRRLMNIGVPEEFLDYSGIVNFAKNDKSRIPELVSTILPPDEEVAEVIQDAKAKNKKVSVGPNMKGRFRESMLWLQWLMFEREPEKVLRKLSKIGQRGVCGAVWGNNDIAYRCRTCEHDPTCAICVPCFQNGNHKEHDYSIIYTGGGCCDCGDVTAWKREGFCSRHKGAEQIQPLPEKYANSAAPVLDALFIYWENKLSLAESVGQENPRASDHVAERRKLANELTFAVVEMLLEFCKNSESLLSFVSKRVISVIGLLDILVRAEMFSSDVVVRKLHELLLKLLGEPIFKYEFAKVFLSYYPVFVKDAIREHSDDTIKKYPLLSTFSVQIFTVPTLTPRLVKEMNLLEMLLGCLREIFDSCAGDDSCLQVAKWANLYETTNRVIGDIRFVMSHAAVSKYATHEQLNISKAWMKLLTFVQGMNPQKRETGIHIREENEYMHLPLVLDHSIANIQPLLVDGAFSSAVSEETRYDFSMYKQDIGDGDSLRHAKVGRLSQESSVCGAMGRSSLSASTLKADDVIFDAVSDVLLPHSVTWVAHECLRAMENWLGVDDRSVSVNDILSPNASRISGSNFVALKKTLSKIKKGKSIFSRLAGSSEVTAGIQESGDLDNATSMGKESKITISGERDTASWRSAGFNDSEMEGECATELDNLHVLSLCYWPDITYDVSSQDVSVHIPLHRLLSLIIQKALRRCYGESAASESADTGAENPLSAVSLDFFGHILGGCHPYGFSAFVMEHPLRIRVFCAQVHAGMWRRNGDAALSSCEWYRAVRWSEQGLELDLFLLQCCAALAPADLYVNRIIERFGLSNYLSLNLERPSEYEPILVQEMLTLIIQILQERRFCGLTTAESLKRELVHRLAIGDATHSQLVKSLPRDLSKFDQLQEILDAVAMYSHPSGFNQGMYSLRWSYWKELDIYHPRWSSRDLQVAEERYLRFCSVSALTAQLPRWTKIYYPLESIAGIATCKVVLQVIRAVLFYAVFTDNPTDSRAPYGVLLTALHLLALALDVCFQKKKSGDQSCDIGGSTPILDFASEEIAEGLNNGAGKQSLLSLLVFLMGMYKKDGADNFLEAGNCNLSSVIESLLKKFAEIDSRCMTKLQQLAPEIVSHLSQSLPRDDTSGSFSASDSEKRKAKARERQAAILEKMKAEQFKFLSSISSNIEDAPKSAPEVTNYDAEHVSEESVQDVCALCHDPNSRTPVSYLILLQKSRLLSFVDRGSPSWDQDQWLGKECGTISANNMVNQFGTNTPSSGLGVISSCQLAQVAEEAVNQFAYNGKPEEVNSVLEFVKAQFPSLRNIPIPFTFSNGRKCTASSMEMFEQDLYLSICREMRKNMTYPDLMKEDEECSVAEGGLKNRGNSDSFLLGKYVASISKEMRENASASEVSRGDRIAAESLVYDGFGPIDCDGIHLSSCGHAVHQGCLDRYVSSLKERYNRRIIFEGGHIVDPDQGEFLCPVCRQLANSVLPALPWDLQRINEQPTVSGVGLSLDSSSSFTTREENTSFQLQQAVSLLQSASNVVGKADVIESFPLMKNEIMASNVEAVSRRMCKMYFQNKLDKFFGSARVNPSLIMWDALKYSLMSMEIAARSEKTSTTPIYDVNALDKELKSSSGFVLSLLLKVVQSMRSKNSLHVLQRFRGIQLFAESICSGTSIDNPGGRCKRGGNMLSILKHADVEVSYPDIQFWNRASDPVLARDPFSSLMWVLFCLPCQFILCKESLLSLVHVFYAVTLSQAVLSCCGKLQSKVNELGFSDSLISDISKLLGEFGSAQEYFVSNYIDPSCDIKDMIRRLSFPYLRSDMMDSSDDALSDLKEIQEVEKMFKIPSLDVILKDEVLRSLVLKWFHHFSKEFEVHRFQHVLYSTPAVPFKLMCLPHLYQDLLQRYIKQCCSDCKSVLDEPALCLLCGRLCSPSWKPCCRESSCQSHAVACGAGTGVFLLIRRTTILLQRCARQAPWPSPYLDAFGEEDIEMHRGKPLYLNEERYAALTYMVASHGLDRSSKVLSQTTIGGFFLV

SEQ ID NO: 21 - protein, 2144 aa, Citrus unshiu
MEIDSPPDFSPPKPRDRIVRRLINIGVPEEFLDYSGIVNFAKNDKSRIPELVSTILPPDEEVAEVIQDAKAKNKKVSVGPNMKGRFRESMLWLQWLMFEREPEKVLRKLSKIGQRGVCGAVWGNNDIAYRCRTCEHDPTCAICVPCFQNGNHKEHDYSIIYTGGGCCDCGDVTAWKREGFCSRHKGAEQIQPLPEKYANSAAPVLDALFIYWENKLSLAESVGQENPRASDHVAERRKLANELTFAVVEMLLEFCKNSESLLSFVSKRVISVIGLLDILVRAERFSSDVVVRKLHELLLKLLGEPIFKYEFAKVFLSYYPVFVKDAIREHSDDTIKKYPLLSTFSVQIFTVPTLTPRLVKEMNLLEMLLGCLREIFDSCAGDDSCLQVAKWANLYETTNRVIGDIRFVMSHAAVSKYATHEQLNISKAWMKLLTFVQGMNPQKRETGIHIREENEYMHLPLVLDHSIANIQPLLVDGAFSSAVAEETRYDFSMYKQDIGDGDSLRHAKVGRLSQESSVCGAMGRSSLSASTLKVDDVIFDAVSDVLLPHSVTWLAHECLRAMENWLGVDDRSVSVNDILSPNASRISGSNFVALKKTLSKIKKGKSIFSRLAGSSEVTAGIQESGDLDNATSMGKESKITISGERDTASWRSAGFNDSEMEGECATELDNLHVLSLCYWPDITYDVSSQDVSVHIPLHRLLSLIIQKALRRCYGESAASESADTGAENPLSAVSLDFFRHILGGCHPYGFSAFVMEHPLRIRVFCAQVHAGMWRRNGDAALSSCEWYRAVRWSEQGLELDLFLLQCCAALAPADLYVNRIIERFGLSNYLSLNLERPSEYEPILVQEMLTLIIQILQERRFCGLTTAESLKRELVHRLAIGDATHSQLVKSLPRDLSKFDQLQEILDAVAMYSHPSGFNQGMYSLRWSYWKELDIYHPRWSSRDLQVAEERYLRFCSVSALTAQLPRWTKIYYPLESIAGIATCKVVLQVIRVVLFYAVFTDNPTDSRAPYGVLLTALHLLALALDVCFQKKKSGDQSRDIGGSTPILDFASEEIAEGLNNGAGKQSLLSLLVFLMGMYKKDGADNFLEAGNCNLSSVIESLLKKFAEIDSRCMTKLQQLAPEIVSHLSQSLPRDDTSGSFSASDSEKRKAKARERQAAILEKMKAEQFKFLSSISSNIEDAPKSAPEVTNYDAEHVSEESVQDVCALCHDPNSRTPVSYLILLQKSRLLSFVDRGSPSWDQDQWLGKECGTISANNMVNQFGTNTPSSALGVISSCQLAQVAEEAVNQFAYNGKPEEVNAVLEFVKAQFPSLRNIPIPFTFSNGRKCTASSMEMFEQDLYLSICREMRKNMTYPDLMKEDEECSVAEGGLKNRGNSDSFLLGKYVASISKEMRENASASEVSRGDRIAAESLVYDGFGPIDCDGIHLSSCGHAVHQGCLDRYVSSLKERYNRRIIFEGGHIVDPDQGEFLCPVCRQLANSVLPALPWDLQRINEQPTVSGVGLSLDSNSSFTTREENTSLQLQQAVSLLQSASNVVGKADVIESFPLLKNEIMASNVEAVSRRMCKMYFQNKLDKFFGSARVNPSLIMWDALKYSLMSMEIAARSEKTSTTPIYDVNALDKELKSSSGFVLSLLLKVVQSMRSKNSLHVLQRFRGIQLFAESICSGTSIDNPGGRCKRGGNMLSILKHADVEVSYPDIQFWNRASDPVLARDPFSSLMWVLFCLPCQFILCKESLLSLVHVFYAVTLSQAVLSCCGKLQSKVNELGFSDSLISDISKLLGEFGSAQEYFVSNYIDPSCDIKDMIRRLSFPYLRRCALLWKLLNSTVPPPFSDRDHVLARSSHGISDMMDSSDDALSDLKEIQEVEKMFKIPSLDVILKDEVLRSLVLKWFHHFSKEFEVHRFQHVLYSTPAVPFKLMCLPHLYQDLLQSVALIASLFLMNLLCACYVVDYVPQAGSHAAGKAVVKAMQWPVVLVLRTTILLQRCARQAPWPSPYLDAFGEEDIEMHRGKPLYLNEERYAALTYMVASHGLDRSSKVLSQTTIGGFFLGKKTVLRNPKIAKLLVFNFMENKLRILDAGRLETNSFVAFWLRRAFALAYIYIYTPKALQIFISLNLNEFGVHRRSAAGKYTSSAPLNGCTVICKA

SEQ ID NO: 22 - protein, 2014 aa, Citrus sinensis
MEIDSPPDFSPPKPRDRIVRRLMNIGVPEEFLDYSGIVNFAKNDKSRIPELVSTILPPDEEVAEVIQDAKAKNKKVSVGPNMKGRFRESMLWLQWLMFEREPEKVLRKLSKIGQRGVCGAVWGNNDIAYRCRTCEHDPTCAICVPCFQNGNHKEHDYSIIYTGGGCCDCGDVTAWKREGFCSRHKGAEQIQPLPEKYANSAAPVLDALFIYWENKLSLAESVGQENPRASDHVAERRKLANELTFAVVEMLLEFCKNSESLLSFVSKRVISVIGLLDILVRAEMFSSDVVVRKLHELLLKLLGEPIFKYEFAKVFLSYYPVFVKDAIREHSDDTIKKYPLLSTFSVQIFTVPTLTPRLVKEMNLLEMLLGCLREIFDSCAGDDSCLQVAKWANLYETTNRVIGDIRFVMSHAAVSKYATHEQLNISKAWMKLLTFVQGMNPQKRETGIHIREENEYMHLPLVLDHSIANIQPLLVDGAFSSAVSEETRYDFSMYKQDIGDGDSLRHAKVGRLSQESSVCGAMGRSSLSASTLKADDVIFDAVSDVLLPHSVTWVAHECLRAMENWLGVDDRSVSVNDILSPNASRISGSNFVALKKTLSKIKKGKSIFSRLAGSSEVTAGIQESGDLDNATSMGKESKITISGERDTASWRSAGFNDSEMEGECATELDNLHVLSLCYWPDITYDVSSQDVSVHIPLHRLLSLIIQKALRRCYGESAASESADTGAENPLSAVSLDFFGHILGGCHPYGFSAFVMEHPLRIRVFCAQVHAGMWRRNGDAALSSCEWYRAVRWSEQGLELDLFLLQCCAALAPADLYVNRIIERFGLSNYLSLNLERPSEYEPILVQEMLTLIIQILQERRFCGLTTAESLKRELVHRLAIGDATHSQLVKSLPRDLSKFDQLQEILDAVAMYSHPSGFNQGMYSLRWSYWKELDIYHPRWSSRDLQVAEERYLRFCSVSALTAQLPRWTKIYYPLESIAGIATCKVVLQVIRAVLFYAVFTDNPTDSRAPYGVLLTALHLLALALDVCFQKKKSGDQSCDIGGSTPILDFASEEIAEGLNNGAGKQSLLSLLVFLMGMYKKDGADNFLEAGNCNLSSVIESLLKKFAEIDSRCMTKLQQLAPEIVSHLSQSLPRDDTSGSFSASDSEKRKAKARERQAAILEKMKAEQFKFLSSISSNIEDAPKSAPEVTNYDAEHVSEESVQDVCALCHDPNSRTPVSYLILLQKSRLLSFVDRGSPSWDQDQWLGKECGTISANNMVNQFGTNTPSSGLGVISSCQLAQVAEEAVNQFAYNGKPEEVNSVLEFVKAQFPSLRNIPIPFTFSNGRKCTASSMEMFEQDLYLSICREMRKNMTYPDLMKEDEECSVAEGGLKNRGNSDSFLLGKYVASISKEMRENASASEVSRGDRIAAESLVYDGFGPIDCDGIHLSSCGHAVHQGCLDRYVSSLKERYNRRIIFEGGHIVDPDQGEFLCPVCRQLANSVLPALPWDLQRINEQPTVSGVGLSLDSSSSFTTREENTSFQLQQAVSLLQSASNVVGKADVIESFPLMKNEIMASNVEAVSRRMCKMYFQNKLDKFFGSARVNPSLIMWDALKYSLMSMEIAARSEKTSTTPIYDVNALDKELKSSSGFVLSLLLKVVQSMRSKNSLHVLQRFRGIQLFAESICSGTSIDNPGGRCKRGGNMLSILKHADVEVSYPDIQFWNRASDPVLARDPFSSLMWVLFCLPCQFILCKESLLSLVHVFYAVTLSQAVLSCCGKLQSKVNELGFSDSLISDISKLLGEFGSAQEYFVSNYIDPSCDIKDMIRRLSFPYLRRCALLWKLLNSTVPPPFSDRDHVLARSSHGISDMMDSSDDALSDLKEIQEVEKMFKIPSLDVILKDEVLRSLVLKWFHHFSKEFEVHRFQHVLYSTPAVPFKLMCLPHLYQDLLQRYIKQCCSDCKSVLDEPALCLLCGRLCSPSWKPCCRESSCQSHAVACGAGTGVFLLIRVFSAPSFNRKLNIIVLCVYCCACCLLA

SEQ ID NO: 23 - protein, 1764 aa, Citrus sinensis
MEIDSPPDFSPPKPRDRIVRRLMNIGVPEEFLDYSGIVNFAKNDKSRIPELVSTILPPDEEVAEVIQDAKAKNKKVSVGPNMKGRFRESMLWLQWLMFEREPEKVLRKLSKIGQRGVCGAVWGNNDIAYRCRTCEHDPTCAICVPCFQNGNHKEHDYSIIYTGGGCCDCGDVTAWKREGFCSRHKGAEQIQPLPEKYANSAAPVLDALFIYWENKLSLAESVGQENPRASDHVAERRKLANELTFAVVEMLLEFCKNSESLLSFVSKRVISVIGLLDILVRAEMFSSDVVVRKLHELLLKLLGEPIFKYEFAKVFLSYYPVFVKDAIREHSDDTIKKYPLLSTFSVQIFTVPTLTPRLVKEMNLLEMLLGCLREIFDSCAGDDSCLQVAKWANLYETTNRVIGDIRFVMSHAAVSKYATHEQLNISKAWMKLLTFVQGMNPQKRETGIHIREENEYMHLPLVLDHSIANIQPLLVDGAFSSAVSEETRYDFSMYKQDIGDGDSLRHAKVGRLSQESSVCGAMGRSSLSASTLKADDVIFDAVSDVLLPHSVTWVAHECLRAMENWLGVDDRSVSVNDILSPNASRISGSNFVALKKTLSKIKKGKSIFSRLAGSSEVTAGIQESGDLDNATSMGKESKITISGERDTASWRSAGFNDSEMEGECATELDNLHVLSLCYWPDITYDVSSQDVSVHIPLHRLLSLIIQKALRRCYGESAASESADTGAENPLSAVSLDFFGHILGGCHPYGFSAFVMEHPLRIRVFCAQVHAGMWRRNGDAALSSCEWYRAVRWSEQGLELDLFLLQCCAALAPADLYVNRIIERFGLSNYLSLNLERPSEYEPILVQEMLTLIIQILQERRFCGLTTAESLKRELVHRLAIGDATHSQLVKSLPRDLSKFDQLQEILDAVAMYSHPSGFNQGMYSLRWSYWKELDIYHPRWSSRDLQVAEERYLRFCSVSALTAQLPRWTKIYYPLESIAGIATCKVVLQVIRAVLFYAVFTDNPTDSRAPYGVLLTALHLLALALDVCFQKKKSGDQSCDIGGSTPILDFASEEIAEGLNNGAGKQSLLSLLVFLMGMYKKDGADNFLEAGNCNLSSVIESLLKKFAEIDSRCMTKLQQLAPEIVSHLSQSLPRDDTSGSFSASDSEKRKAKARERQAAILEKMKAEQFKFLSSISSNIEDAPKSAPEVTNYDAEHVSEESVQDVCALCHDPNSRTPVSYLILLQKSRLLSFVDRGSPSWDQDQWLGKECGTISANNMVNQFGTNTPSSGLGVISSCQLAQVAEEAVNQFAYNGKPEEVNSVLEFVKAQFPSLRNIPIPFTFSNGRKCTASSMEMFEQDLYLSICREMRKNMTYPDLMKEDEECSVAEGGLKNRGNSDSFLLGKYVASISKEMRENASASEVSRGDRIAAESLVYDGFGPIDCDGIHLSSCGHAVHQGCLDRYVSSLKERYNRRIIFEGGHIVDPDQGEFLCPVCRQLANSVLPALPWDLQRINEQPTVSGVGLSLDSSSSFTTREENTSFQLQQAVSLLQSASNVVGKADVIESFPLMKNEIMASNVEAVSRRMCKMYFQNKLDKFFGSARVNPSLIMWDALKYSLMSMEIAARSEKTSTTPIYDVNALDKELKSSSGFVLSLLLKVVQSMRSKNSLHVLQRFRGIQLFAESICSGTSIDNPGGRCKRGGNMLSILKHADVEVSYPDIQFWNRASDPVLARDPFSSLMWVLFCLPCQFILCKESLLSLVHVFYAVTLSQYYHVVGNFNPRLMS

SEQ ID NO: 24 - protein, 1482 aa, Citrus sinensis
MEIDSPPDFSPPKPRDRIVRRLMNIGVPEEFLDYSGIVNFAKNDKSRIPELVSTILPPDEEVAEVIQDAKAKNKKVSVGPNMKGRFRESMLWLQWLMFEREPEKVLRKLSKIGQRGVCGAVWGNNDIAYRCRTCEHDPTCAICVPCFQNGNHKEHDYSIIYTGGGCCDCGDVTAWKREGFCSRHKGAEQIQPLPEKYANSAAPVLDALFIYWENKLSLAESVGQENPRASDHVAERRKLANELTFAVVEMLLEFCKNSESLLSFVSKRVISVIGLLDILVRAEMFSSDVVVRKLHELLLKLLGEPIFKYEFAKVFLSYYPVFVKDAIREHSDDTIKKYPLLSTFSVQIFTVPTLTPRLVKEMNLLEMLLGCLREIFDSCAGDDSCLQVAKWANLYETTNRVIGDIRFVMSHAAVSKYATHEQLNISKAWMKLLTFVQGMNPQKRETGIHIREENEYMHLPLVLDHSIANIQPLLVDGAFSSAVSEETRYDFSMYKQDIGDGDSLRHAKVGRLSQESSVCGAMGRSSLSASTLKADDVIFDAVSDVLLPHSVTWVAHECLRAMENWLGVDDRSVSVNDILSPNASRISGSNFVALKKTLSKIKKGKSIFSRLAGSSEVTAGIQESGDLDNATSMGKESKITISGERDTASWRSAGFNDSEMEGECATELDNLHVLSLCYWPDITYDVSSQDVSVHIPLHRLLSLIIQKALRRCYGESAASESADTGAENPLSAVSLDFFGHILGGCHPYGFSAFVMEHPLRIRVFCAQVHAGMWRRNGDAALSSCEWYRAVRWSEQGLELDLFLLQCCAALAPADLYVNRIIERFGLSNYLSLNLERPSEYEPILVQEMLTLIIQILQERRFCGLTTAESLKRELVHRLAIGDATHSQLVKSLPRDLSKFDQLQEILDAVAMYSHPSGFNQGMYSLRWSYWKELDIYHPRWSSRDLQVAEERYLRFCSVSALTAQLPRWTKIYYPLESIAGIATCKVVLQVIRAVLFYAVFTDNPTDSRAPYGVLLTALHLLALALDVCFQKKKSGDQSCDIGGSTPILDFASEEIAEGLNNGAGKQSLLSLLVFLMGMYKKDGADNFLEAGNCNLSSVIESLLKKFAEIDSRCMTKLQQLAPEIVSHLSQSLPRDDTSGSFSASDSEKRKAKARERQAAILEKMKAEQFKFLSSISSNIEDAPKSAPEVTNYDAEHVSEESVQDVCALCHDPNSRTPVSYLILLQKSRLLSFVDRGSPSWDQDQWLGKECGTISANNMVNQFGTNTPSSGLGVISSCQLAQVAEEAVNQFAYNGKPEEVNSVLEFVKAQFPSEMRKNMTYPDLMKEDEECSVAEGGLKNRGNSDSFLLGKYVASISKEMRENASASEVSRGDRIAAESLVYDGFGPIDCDGIHLSSCGHAVHQGCLDRYVSSLKERQVLPTTKGNLILLLNATDLLITWLFSISQDDLLENVDKVLEWAILTGFALLCFLFESFHYIMQLHL

SEQ ID NO: 25 - protein, 2060 aa, Atalantia buxifolia
MEIDPPPDFSPPKPRDRIVRRLINIGVLEEFLDYSGIVNFAKNDRSRIPELVSTILPPDEEVAEVIQDAKAKNKKISVGLNMKGRFRESMLWLQWLMFEREPEKVLRKLSKIGQRGVCGAVWGNNDIAYRCRTCEHDPTCAICVPCFQNGNHKEHDYSIIYTGGGCCDCGDVTAWKREGFCSRHKGAEQIQPLPEKYANSAVPVLDALFIYWENKLSSAESVGQENPRASDHVAERRKLANELTFAVVEMLLEFCKNSESLLSFVSKRVISVVGLLDILVRAERFLNDVVVRKLHELLLKLLGEPIFKYEFAKVFLSYYPVFVKDAIREHSDDTIKKYPLLSTFSVQIFTVPTLTPRLVKEMNLLEMLLECLREIFDSCAGDNSCLQVAKGANLYETTNRVIGDIRFVMSHAAVSKYATHEQLDISKTWLKLLTFVQGMNPQKRETGIPIREETEYMHLPLVLDHSIANIQPLLVDGAFSSAVAEETCYDFSMYKQDIGDGDSLRHAKVGRLSQESSVCGAMGRSSLSASTLKADDVIVDAISDVLLPHSVTWIAHECLRAMENWLGVNDRSVSVNDIVSPNASRISGSNFVALKKTLSKIKKGKSIFSRLAGSSEVTAGIQESGDLDNATSMGKESKITISGERDTASWRSAGFNDSQMEGECATELDNLHVLSLCYWPDIMYDVSSQDVSVHIPLHRLLSLIIQKALRRCYGESAASESADTGAENPLSAVSLDFFGHVLGGCHPYGFSAFVMEHPLRIRVFCAQVHAGMWRRNGDAALSSCEWYRAVRWSEQGLELDLFLLQCCAALAPADQYVNRIIERFGLSNYLSLNLERPSEYEPILVQEMLTLIIQILQERRFCGLTTAESLKRELVHRLAIGDTTHSQLVKSLPRDLSKFDRLQEILDAVAMYSHPSGFNQGMYSLRWSYWKELDIYHPRWSSRDLQVAEERYLRFCSVSALTSQLPRWTKIYFPLESIAGIATCKVVLQVIHAVLFYAVFTDKPTDSRAPYGALLTALHLLALALDVCFQKKKSGDQSCDIGGSTPILDFASDEIAEGLNNGAGKQSLLSLLVFLMGMYKKDGAANFLEAGNCNLSSLIESLLKKFAEIDSRCMTKLQQLAPEIVSHLSQSLPRDDTSGSFSASDSEKRKAKARERQAAILEKMKAEQFKFLSSISSNIEDAPKSAPEVTNYDAEHVSEESVQDVCALCHDPNSRTPVSYLILLQKSRLLSFVDRGSPSWDQDQWLGKECGAISANNMVNQFGTNTPSSGLGVISSCQLAQVAEEAVNQFAYNGKPEEVNAVLEFVKAQFPSLRNIQIPFTFSNGRKCTASSMEVFEQDLYLSICREMRKNMTCPDLMKEDEECSVAEGGLKNRGNSDSVLLGKYVASISKEMRENPSASEVSHGDRIAAESLVYDGFGPIDCDGIHLSSCGHAVHQGCLDRYVSSLKERYNRRIIFEGGHIVDPDQGEFLCPVCRQLANSVLPALPWDLQRINEQPTLSGVGLSLDSNSSFTPREENTSLQLQQAASLLQSASNVVGKADVIESFPLMKNEIMASNVEGVSRRMCKMYFQNKLDKFFGSARVNPSLIMWDALKYSLMSMEIAARSEKTSMTPIYDVNALDKELKSSSGFVLSLLLKVVQSMRSKNSLHVLQRFRGIQLFAESICSGTSIDNPGGRCKRGGNMLSILKHADVEVSYPDIQFWNRASDPVLARDPFSSLMWVLFCLPCQFILCKESLLSLVHVFYAVTLSQAVLSCCGKLQSKVNELGFSDSLISDISKLLGEFGSAQEYFVSNYIDPSCDIKDMIRRLSFPYLRRCALLWKLLNSTVPPPFSDRDHVLARSSHGISDMMDSSDDALSDLKEIQEVEKMFKIPSLDVILKDKVLRSLVLKWFHHFFKEFEVHRSQRVLYSTPAVPFKLLRLPHLYQDLLQRYIKQCCPDCNSVLDEPALCLLCGRLCSPSWKPCCRESSCQSHAMACGAGTGVFLLIRRTTILLQRCARQAPWPSPYLDAFGEEDIEMHRGKPLYLNEERYAALTYMVASHGLDRSSKVLSQTTIGGFFLV

SEQ ID NO: 26 - protein, 2043 aa, Solanum lycopersicum
MDTGSSPESDTLTPMERILKRLDILGVPAEYLELLQPGLVAYVKNNKSQIAELVPALFPTNEEAVEIIAEQQIQSPRSMVSSSVNVKDLFQESMEWIQWLMFDGEPSRALEQLEDTGQRGVCGAVWGNNDIAYRCRTCEHDPTCAICVPCFQNGNHKDHDYSIIYTGGGCCDCGDVTAWKREGFCSKHKGAEQIQPLPEEFANSMGPVLDLLLSCWRKRFLFPDSISGRNPRKNDHSTELKMVTDELTSAVVKMLLKFCKHSESLLSFISRRVSSSAGLLDILVRAERFMIIEENVKKIHELLLKLLGEPQFKYEFAKVFLSYYPTVVNEATSECNDSVYNKYPLLSTFSVQIFTVPTLTPRLVKEMNLLPMLLGCLGDIFASCAGEDGKLQVMKWSNLYETTLRVVEDIRFVMSHSVVPRYVTHERRDILRTWMKLLAFVQGANPQKRETGIHVEEENENMHLPFVLGHSIANIHSLLVSGAFSTSSTEDGADAFFNTHREDFEDQDSQRHAKVGRLSQESSVCSMAGRSPLEHASRVLEVHYDSSPISSSVLCLTFECLRAIENWLIVDNTSGPLLHILCPKTSSTPGNNFSVLKKTLSKFRRGREMFKSQSPPSNDVRLVTSAEGYNKQYSNPSLNGRTILDSGLGSGQEPACLGGHDDSMLEGDNASELGELRLLSLSDWPDIVYKVSLQDISVHNPLQRLLSMVLQKALGKCYGENAQPVASSAKLSSSVHYDFFGHILGVYHPQGFSAFIMEHALRIRVFCAQVYAGMWRRNGDSAILSCEWYRSVRWSEQGLELDLFLLQCCAALAPADLYISRILERFELSNYLSFNLERPSEYEPALVQEMLTLIIQILKERRFCGLTSSECLQRELVYRLSIGDATHSQLVKSLPRDLSKIDKFQEVLDKIAIYSNPSGMNQGMYKLRLPYWKELDLYHPRWNSRDLQVAEERYMRFCNASALTTQLPGWSKIYPPLGRIAEVATCRTVLQIVRAVVSYAVFSDASNASCAPDGVLLRALHLLSLALDICHAHRESGEHSCSNGDVIPILALACEEISVGKFGDQSLLSLLVLLMRKHKKENYFVEAGMLNLLSLVESVLKKFAELQPECMKKLQDLAPDVVNQLSRSFPAGDMNSFKSVSDSDKHKAKARERQAAMLEKMRVQQSKFLASIDSKTDVAADDSKHGKDLCDSDGRPRSEEATPVICSLCRDPNSRSPVSYLILLQKSRLLSCTNRGPPSWEQTRRPGKEPTSCAKHVPNISSERSNLSRSSEITSSSCLMQLIQNKVNEFALEGQPKEVEAFLEYIKEKFPSMKNIQPSCASSTVKKKTSSSFEMLEEHMYSLIWEEMDANSWNWDLLKNDRKLSALGDNGSAESLLLGRYISALSRECSPSASTNSRKAQLESSMLLPTYNGFGPSDCDGIYLSSCGHAVHQGCLDRYLSSLKERYTRQIVFEGGHIVDPDQGEFLCPVCRGLANSVLPALPAETKRSTPSLSTDPSDAVGLPTLRFQEVLFLLQSAADVAGSREILQSLPVQQFGQMRVNLDYVVRILCEMYFPDKDKISESGRLSHSLILFDTLKYSLISTEIAARSGNTSLAPNYSLGALYKELKSTNCFILALLLSIVQSTRSKDSLTVLLRLRGIQLFVKSICSDISADEYPDSPIVGGNMQDILEFSETELQYPDIQFWKRCSDPVLAHDAFSSLTWVLYCLPCQFLSCEKSFLCLVHLFYVVTITQIVITYSRKLQSSLSMSGCSDSLVTDIYRIIAENGVAYKDFDSNHIETHDVKDAIRSLSFPYLRRCALLWKLVRSSVSAPFSGGSNILDGLPYSMGETMECGGNIPVEFNEIEKLEKLFKIPPLDDVISDETVRFVVPSWLRRFSKQFEARMLNGAMYSSPAVPFKLMLLPHLYQDLLQRYIKQNCPDCGVVLEEPALCLLCGRLCSPNWKPCCRESGCQTHAMACGAGTGVFLLIKKTTVLLQRSARQASWPSPYLDAFGEEDSGMNRGKPLYLNEERYAALTHMVASHGLDRSPKVLHQTNIGNFFVL

SEQ ID NO: 27 - protein, 2042 aa, Solanum tuberosum
METDSSPESDTLTPMERILQRLDILGVPAENLEQLQPGLVAYVKNNKSQIAELVPALLPTNEEAMEIITEQQMESPRSTVSSSVNVKDLFQESMDWIQWLMFDGEPSRALEQLEDTGERGVCGAVWGNNDIAYRCRTCEHDPTCAICVPCFQNGNHKDHDYSIIYTGGGCCDCGDVTAWKREGFCSKHKGAEQIKPLPEEFANSMGPVLDLLLSCWRKRLLFPDSISGRNPRRNDHATELKMVTDELTSAVVEMLLKFCKHSESLLSFISRRVSCSAGLLDILVRAERFMITEENVKKIHELLLKLLGEPQFKYEFAKVFLSYYPTVVNEATRECNDSVFNKYPLLSTFSVQIFTVPTLTPRLVKEMNLLPMLLGCLGDIFASCAGEDGKLQVMKWSDLYETTLRVVEDIRFVMSHSVVPRYATHDRRDILRTWIKLLAFVQGTDPQKRETGIHVEEESENMHLPFVLGHSIANIHSLLVGGAFSISTEDAADAFFNTHTEDFEDQDSQRHAKVGRLSQESSVCSMAGRSPLEHASRVPEVTYDSSPISSSVLCLTFECLRAIENWLIVDNTSGALLHILCPKTSSTPGNNFSMLKKTLSKFRRGREMFKSQSPPSNEVRLLTSAEGYNKQYSNPSLNGRTTLDSGQGSGQEAACLGGLDDSMLEGDNASELEALRLLSLSDWPDIVYKVSLQDISVHNPLHRLLSMVLQRALGKCYGESAQPVASSAKLSSSVHYDFFGHILGGYHPQGFSAFIMEHALRIRVFCAQVHAGMWRRNGDAAILSCEWYRSVRWSEQGLELDLFLLQCCAALAPADLYISRILERFELSNYLLFNLERPSEYEPTLVQEMLTLIIQILRERRFCGLTSSECLQRELVYRLSIGDATHSQLVKSLPRDLSKIDKFQEVLDKIAIYSNPSGMNQGMYKLRLPYWKELDLYHPRWNSRDVQVAEERYMRFCNASALTTQLPGWSKIYPPLGRIAEVATCRTVLQIVRAVVSYAVFSDASNASRAPDGVLLRALHLLSLALDICHAQRESGEHSCYNGDVIPILALACEEISVGKFGDQSLLSLLVLLMRKHKKENYFVEAGMLNLLSLVESVLKKFAELQPECMKKLQDLAPDVVNQLSRSFPSGDMNSFRSFSDSDKHKAKARERQAAMLEKMRVQQSKFLASIDSTTDVAADDSKHGKDLCDSDGRPRSEEATPVICSLCRDPNSRSPVSHLVLLQKSRLLSCTNRGPPSWEQTRRPGKEPTSCAKQVPNISSERSNLSRSSEITSSSWLMQLIQNKVNEFALEGQPKEVEAFLEYIKEKFPLMKNIQPSCASSTVKKKTSSSFEMLEEHMYSLIWEEMDANSRNWDLLKNDRKLSALGDNGSAESLLLGRYISALSRECSPSASTNSRKAQLESSMLLPTYKGFGPSDCDGIYLSSCGHAVHQGCLDRYLSSLKERYTRQIVFEGGHIVDPDQGEFLCPVCRGLANSVLPALPAETKRSTPSLSTGPSDAVGLSTLRFQEALFLLQSAADVAGSREILQSLPLQQFGQMRVNLDYVVRVLCEMYFPDKDKISESGRLSHSLILFDTLKYSLMSTEIAARSGNTSLAPNYSLGALYKELKSTNCFIFALLLSIVQSTRTKDSLTVLLRLRGIQLFVKSICSDISADECPDSPIVGGNMQDILEFSETELQYPDIQFWKRSSDPVLAHDAFSSLMWVLYCLPCQFLSCEKSFLCLVHLFYVVSITQIVITYSRKRQSSLSMSGCSDSLVTDIYRIIEENGVAYIYFDSNHIETHDVKDAIRSLSFPYLRRCALLWKLVRSSVSAPFSGGSNILDGLPYSMGETMECGGNIPVEFNEIEKLEKLFKIPPLDDVISDEIVRFVVPRWLRHFSKQFEARTLNGVMYSTPAVPFKLMLLPHLYQDLLQRYIKQHCPDCGVVLEEPALCLLCGRLCSPNWKPCCRESGCQTHAMACGAGTGVFLLIKKTTVLLQRSARQASWPSPYLDAFGEEDSGMNRGKPLYLNEERYAALTHMVASHGLDRSPKVLHQTNIGNFLML

SEQ ID NO: 28 - protein, 752 aa, Citrus trifoliata
MTLYDHDGSVPQSEYSDRHLRISGDGEVNDNPIEEVRLTVPITDDPSLPVLTFRTWVLGILSCGLLAFLNRFFGFRQNQLTVSSVSAQILVLPIGKLMAATLPTKKFKCPITNWSFSFNPGPFNIKEHVLITIFASCGASGVYAVHIIAMLRAFYKRSIHPVAALLLALTTQMLGYGWAGIFRRYLVDSPYMWWPANLVQVSLFRALHEKEKRPKGGLTRIQFFFVVFVSSFAYYIVPGYLFPSLTALSFVCWIWKRSVTAQQIGSGLSGLGIGAIGIDWSTVSSFLGSPLATPLFAIVNTLVGFALVMYILLPISYWNNVYEAKRFPIFGAATFDAQGRKYNVDRVLNKETFDLNVEAYNGYSKLYLSVFFAFTYGLSFATLTASISHVALFDGKSIMEMWMKTKDAVGDKFADVHTRMMKSNYDSVPGWWFHAVLVVSVALALYACEGFGKVLQLPWWGLLLACLIALGFTLPIGIINATTNQQPGLNVITELIIGFLYPGKPVANVVFKTYGYISMAQALAFLSDFKLGHYMKIPPKSMFIVQLVGTVVASSVYFVTAWWLLGSIKDICDTAALPEGSPWTCPGDDVFYSASIIWGVIGPGKMFTKEGIYPEMNWCFLIGFLAPVPVWLLSRKFPKKRWIKQIHMPIIIGTASSMPTAKAVHFNTWGVVGIFFNYYIYRKYKAWWARHTYILSGALDAGIAFMGVVIYFALQNYDNFGPNWWGLDSGDHCPLAKCPTAPGVKSKGCPVQ

SEQ ID NO: 29 - protein, 756 aa, Citrus trifoliata
MGSRNFEEDGVPQALSLEKPQTEIKIIGDEEVNDSPIEQVRLTVPITDDPSQPALTFRTWFLGIVSCVVLSFLNRFFGFRQNQLSVGSISAQIIVLPLGKLMAATLPSKPIRLPFTKWTFSMNPGPFNLKEHVLITIFANCGAGGVYAVYIITIVKAFYKRKLNPLAAMLLAQTTQLLGYGWAGLFRKYLVDSPFMWWPANLVQVSLFRALHEKEKRPKGGLTRLQFFFMVFASSFAYYVVPGYLFPTLSALSFVCWIWKNSVTAQQIGAGLNGLGIGSFGLDWSTVASFLGSPLASPVFAIINVLAGFILNLYVLVPIAYWTNTYEAKRFPIFSSHTFDSTGQPYNISRILNEATFDLDHDAFNSYSKLYLSPFFAFNYGLSFATLTATISHVALFDGSDIWQMWKRTTSAARDKFADVHTRLMKKHYEAVPQWWFHIILVATVALSIYACEGFDKQLQLPWWGILLACAIALFFTLPIGIIQATTNQQPGLNVITELIIGYMYPGRPLANVAFKTYGYISMSQALSFLADFKLGHYMKIPPKSMFLVQLIGTVVASSVYFGTAWWLLTSVEHICDPSALPEGSPWTCPGDDVFYSASIIWGIVGPGKMFTKEGVYPALNWFFLVGLLAPVPIWFLSRKFPEIKWIGLIHIPIIFGGTGNMPPARAVHYLSWAAVGIFFNYYVYRRFKGWWARHTYILSAALDAGVAFMGVFLFLTLQSYDIFGPHWWGLDSTDHCPLATCPTAPGIVIKGCPVF

SEQ ID NO: 30 - protein, 773 aa, Citrus trifoliata
MCASHSAMSFTFQFKDRDMGTYVEGGMLQSMSPENSQTDTRTKGDMEEANDNPIEEVRLTVPITDDPTIPALTFRTWVLGLTSCCLLAFVNQFFGYRQNQLYMSSISAQILVLPIGKLMAATLPSKPIPVPLTPWSFSLNPGPFNLKEHVLITIFAGCGSSGVYAVSIITIVKAFYKRSLHILPAMMLVQTTQLLGYGWAGLFRKYLVDSPYMWWPANLVQVSLFRALHEEEKRTKGGLTRLQFFVIVFISSFAYYVVPGYLFPSISALSFVCWIWKDSVTAQKLGSGLQGLGMGSFGLDWATVAGFLGSPLATPFFAIANILVGFFLFLYILIPIAYWCNAFEAQRFPLFSSHTFDYGGQIYNVSRILNEKEFSFDREGYDNYSRLYLSVLFAFIYGLGFATLMASISHVALFEGKTIWQMWRKTTAAVKQQFGDVHTRLMKKNYEAVPQWWFHAILIITFALSLFTCEGFDKQFQLPWWGLLLACAMAFFFTLPVGVIQATTNLQPGLNIITEMVIGYMYPGKPLANVAFKTYGYISMVQALGFLGDFKLGHYMKVPPKSMFVVQLVGTIVASTVYFGTAWWLLTSVEHICNPSLLPEGSPWTCPGDEVFYNASIIWGVVGPLRMFTNYGNYPQMNWFFLIGFLAPFPVWLLSRKFPEKKWIKNIHMPLLLAGPGGLPSAKAVNYLSWGAVGIFFNYYVYRRFKGWWARHTYILSAALDAGVAFMGVFLYFTLQSQDIFGPEWWGLAATDHCPLAKCPIAPGIKVQGCRVA

SEQ ID NO: 31 - protein, 752 aa, Citrus clementina
MTLYDHDGSVPQSEYSDRHLRISGDGEVNDNPIEEVRLTVPITDDPSLPVLTFRTWVLGILSCGLLAFLNRFFGFRQNQLTVSSVSAQILVLPIGKLMAATLPTKKFKCPITNWSFSFNPGPFNIKEHVLITIFASCGASGVYAVHIIAMLRAFYKRSIHPVAALLLALTTQMLGYGWAGLFRRYLVDSPYMWWPANLVQVSLFRALHEKEKRPKGGLTRIQFFFVVFVSSFAYYIVPGYLFPSLTALSFVCWIWKRSVTAQQIGSGLSGLGIGAIGIDWSTVSSFLGSPLATPLFSIVNTLVGFALVMYILLPIFYWNNVYEAKRFPIFSAATFDAQGHKYNVDRVLNKETFDLNVEAYNGYSKLYLSVFFAFIYGLSFATLTASISHVALFDGKNIMEMWMKTKDAVGDKFADVHTRMMKRNYDSVPGWWFHAVLVVSVALALYACEGFGKVLQLPWWGLLLACLIALGFTLPIGIINATTNQQPGLNVITELIIGFLYPGKPVANVVFKTYGYISMAQALAFLSDFKLGHYMKIPPKSMFIVQLVGTVVASSVYFGTAWWLLGSIKDICDPAALPEGSPWTCPGDDVFYSASIIWGVIGPGKMFTKEGIYPEMNWCFLIGFLAPVPVWLLSRKFPKKRWIKQIHMPIIIGTASSMPTAKAVHFNTWGVVGIFFNYYIYRKYKAWWARHTYILSGALDAGIAFMGVVIYFALQNYDNFGPNWWGLDSGDHCPLAKCPTAPGVKSKGCPVR

SEQ ID NO: 32 - protein, 1413 aa, Citrus unshiu
MGSRNFEEDGVPQALSLEKPQTEIKIIGDEEVNDSPIEQVRLTVPITDDPSQPALTFRTWFLGIISCVVLSFLNRFFGFRQNQLSVGSISAQIIVLPLGKLMAATLPSKPIRVPLTKWTFSMNPGPFNLKEHVLITIFANCGAGGVYAVYIITIVKAFYKRKLNPLAAMLLAQTTQLLGYGWAGLFRKYLVDSPFMALHEKEKRPKGGLTRLQFFFMVFASSFAYYVVPGYLFPTLSALSFVCWIWKNSVTAQQIGAGLNGLGIGSFGLDWSTVASFLGSPLASPVFAIINVLAGFILNLYVLVPIAYWTNTYEAKRFPIFSSHTFDSTGQPYNISRILNEATFDLDHDAFNSYSKLYLSPFFAFNYGLSFATLTATISHVALFDGSDIWQMWKRTTSAARDKFADVHTRLMKKHYEAVPQCYNSHGGEFYWLVLLLYSLPYLLQPGLNVITELIIGYMYPGRPLANVAFKTYGYISMSQALSFLADFKLGHYMKIPPKSMFLVQLIGTVVASSVYFGTAWWLLTSVEHICDPSALPEGSPWTCPGDDVFYSASIIWGIVGPGKMFTKEGVYPALNWFFLVGLLAPVPIWFLSRKFPEIKWIRLIHIPIIFGGTGNMPPARAVHYLSWAAVGIFFNYYVYRRFKGWWARHTYILSAALDAGVAFMGVFLFLTLQSYDIFGPHWWGDGEVNDNPIEEVRLTVPITDDPSLPVLTFRTWVLGILSCGLLAFLNRFFGFRQNQLTVSSVSAQILVLPIGKLMAATLPTKKFKCPITNWSFSFNPGPFNIKEHVLITIFASCGASGVYAVHIIAMLRAFYKRSIHPVAALLLALTTQMLGYGWAGIFRRYLVDSPYMWWPANLVQVSLFRALHEKEKRPKGGLTRIQFFFVVFVSSFAYYIVPGYLFPSLTALSFVCWIWKRSVTAQQIGSGLSGLGIGAIGIDWSTVSSFLGSPLATPLFAIVNTLVGFALVMYILLPIFYWNNVYEAKRFPIFGAATFDAQGHKYNVDRVLNKETFDLNVEAYNGYSKLYLSVFFAFTYGLSFATLTASISHVALFDGKSIMEMWMKTKDAVGDKFADVHTRMMRRNYDSVPGWWFHAVLVVSVALALYACEGFGKVLQLPWWGLLLACLIALGFTLPIGIINATTNQQPGLNVITELIIGFLYPGKPVANVVFKTYGYISMAQALAFLSDFKLGHYMKIPPKSMFIVQLVGTVVASSVYFGTAWWLLGSIKDICDTAALPEGSPWTCPGDDVFYSASIIWGVIGPGKMFTKEGIYPEMNWCFLIGFLAPVPVWLLSRKFPKKRWIKQIHMPIIIGTASSMPTAKAVHFNTWGVVGIFFNYYIYRKYKAWWARHTYILSGALDAGIAFMGVVIYFALQNYDNFGPNWWGLDSGDHCPLAKCPTAPGVKSKGCPVQ

SEQ ID NO: 33 - protein, 1301 aa, Citrus unshiu
MGSRNFEEDGVPQALSLEKPQTEIKIIGDEEVNDSPIEQNQLSVGSISAQIIVLPLGKLMAATLPSKPIRVPLTKWTFSMNPGPFNLKEHVLITIFANCGAGEKHRNLLILFDEIQLLGYGWAGLFRKYLVDSPFMWWPANLVQVSLFRALHEKEKRPKGGLTRLQFFFMVFASSFAYYVVPGYLFPTLSALSFVCWIWKNSVTAQQIGAGLNGLGIGSFGLDWSTVASFLGSPLASPVFAIINVLAGFILNLYVLVPIAYWTNTYEAKRFPIFSSHTFDSTGQPYNISRILNEATFDLDHDAFNSYSKLYLSPFFAFNYGLSFATLTATISHVALFDGSDIWQMWKRTTSAARDKFADVHTRLMKKHYEAVPQWWFHIILVATVALSIYACEGFDKQLQLPWPLANVAFKTYGYISMSQALSFLADFKLGHYMKIPPKSMFLVQLIGTVVASSVYFGTAWWLLTSVEHICDPSALPEGSPWTCPGDDVFYSASIIWGIVGTGNMPPARAVHYLSWAAVGIFFNYYVYRRFKGWWARHTYILSAALDAGVAFMGVFLFLTLQSYDIFGPHWWGDGEVNDNPIEEVRLTVPITDDPSLPVLTFRTWVLGILSCGLLAFLNRFFGFRQNQLTVSSVSAQILVLPIGKLMAATLPTKKFKCPITNWSFSFNPGPFNIKEHVLITIFASCGASGVYAVHIIAMLRAFYKRSIHPVAALLLALTTQMLGYGWAGIFRRYLVDSPYMWWPANLVQVSLFRALHEKEKRPKGGLTRIQFFFVVFVSSFAYYIVPGYLFPSLTALSFVCWIWKRSVTAQQIGSGLSGLGIGAIGIDWSTVSSFLGSPLATPLFAIVNTLVGFALVMYILLPIFYWNNVYEAKRFPIFGAATFDAQGHKYNVDRVLNKETFDLNVEAYNGYSKLYLSVFFAFTYGLSFATLTASISHVALFDGKSIMEMWMKTKDAVGDKFADVHTRMMRRNYDSVPGWWFHAVLVVSVALALYACEGFGKVLQLPWWGLLLACLIALGFTLPIGIINATTNQQPGLNVITELIIGFLYPGKPVANVVFKTYGYISMAQALAFLSDFKLGHYMKIPPKSMFIVQLVGTVVASSVYFGTAWWLLGSIKDICDTAALPEGSPWTCPGDDVFYSASIIWGVIGPGKMFTKEGIYPEMNWCFLIGFLAPVPVWLLSRKFPKKRWIKQIHMPIIIGTASSMPTAKAVHFNTWGVVGIFFNYYIYRKYKAWWARHTYILSGALDAGIAFMGVVIYFALQNYDNFGPNWWGLDSGDHCPLAKCPTAPGVKSKGCPVQ

SEQ ID NO: 34 - protein, 1458 aa, Citrus unshiu
MGSRNFEEDGVPQALSLEKPQTEIKIIGDEEVNDSPIEQVRLTVPITDDPSQPALTFRTWFLGIISCVVLSFLNRFFGFRQNQLSVGSISAQIIVLPLGKLMAATLPSKPIRVPLTKWTFSMNPGPFNLKEHVLITIFANCGAGGVYAVYIITIVKAFYKRKLNPLAAMLLAQTTQLLGYGWAGLFRKYLVDSPFMWWPANLVQVSLFRALHEKEKRPKGGLTRLQFFFMVFASSFAYYVVPGYLFPTLSALSFVCWIWKNSVTAQQIGAGLNGLGIGSFGLDWSTVASFLGSPLASPVFAIINVLAGFILNLYVLVPIAYWTNTYEAKRFPIFSSHTFDSTGQPYNISRILNEATFDLDHDAFNSYSKLYLSPFFAFNYGLSFATLTATISHVALFDGSDIWQMWKRTTSAARDKFADVHTRLMKKHYEAVPQWWFHIILVATVALSIYACEGFDKQLQLPWWGILLACAIALFFTLPIGIIQATTNQQPGLNVITELIIGYMYPGRPLANVAFKTYGYISMSQALSFLADFKLGHYMKIPPKSMFLVQLIGTVVASSVYFGTAWWLLTSVEHICDPSALPEGSPWTCPGDDVFYSASIIWGIVGPGKMFTKEGVYPALNWFFLVGLLAPVPIWFLSRKFPEIKWIRLIHIPIIFGGTGNMPPARAVHYLSWAAVGIFFNYYVYRRFKGWWARHTYILSAALDAGVAFMGVFLFLTLQSYDIFGPHWWGDGEVNDNPIEEVRLTVPITDDPSLPVLTFRTWVLGILSCGLLAFLNRFFGFRQNQLTVSSVSAQILVLPIGKLMAATLPTKKFKCPITNWSFSFNPGPFNIKEHVLITIFASCGASGVYAVHIIAMLRAFYKRSIHPVAALLLALTTQMLGYGWAGIFRRYLVDSPYMWWPANLVQVSLFRALHEKEKRPKGGLTRIQFFFVVFVSSFAYYIVPGYLFPSLTALSFVCWIWKRSVTAQQIGSGLSGLGIGAIGIDWSTVSSFLGSPLATPLFAIVNTLVGFALVMYILLPIFYWNNVYEAKRFPIFGAATFDAQGHKYNVDRVLNKETFDLNVEAYNGYSKLYLSVFFAFTYGLSFATLTASISHVALFDGKSIMEMWMKTKDAVGDKFADVHTRMMRRNYDSVPGWWFHAVLVVSVALALYACEGFGKVLQLPWWGLLLACLIALGFTLPIGIINATTNQQPGLNVITELIIGFLYPGKPVANVVFKTYGYISMAQALAFLSDFKLGHYMKIPPKSMFIVQLVGTVVASSVYFGTAWWLLGSIKDICDTAALPEGSPWTCPGDDVFYSASIIWGVIGPGKMFTKEGIYPEMNWCFLIGFLAPVPVWLLSRKFPKKRWIKQIHMPIIIGTASSMPTAKAVHFNTWGVVGIFFNYYIYRKYKAWWARHTYILSGALDAGIAFMGVVIYFALQNYDNFGPNWWGLDSGDHCPLAKCPTAPGVKSKGCPVQ

SEQ ID NO: 35 - protein, 752 aa, Citrus sinensis
MTLYDHDGSVPQSEYSDRHLRISGDGEVNDNPIEEVRLTVPITDDPSLPVLTFRTWVLGILSCGLLAFLNRFFGFRQNQLTVSSVSAQILVLPIGKLMAATLPTKKFKCPITNWSFSFNPGPFNIKEHVLITIFASCGASGVYAVHIIAMLRAFYKRSIHPVAALLLALTTQMLGYGWAGIFRRYLVDSPYMWWPANLVQVSLFRALHEKEKRPKGRLTRIQFFFVVFVSSFAYYIVPGYLFPSLTALSFVCWIWKRSVTAQQIGSGLSGLGIGAIGIDWSTVSSFLGSPLATPLFAIVNTLVGFALVMYILLPIFYWNNVYEAKRFPIFGAATFDAQGHKYNVDRVLNKETFDLNVEAYNGYSKLYLSVFFAFTYGLSFATLTASISHVALFDGKSIMEMWMKTKDAVGDKFADVHTRMMRRNYDSVPGWWFHAVLVVSVALALYACEGFGKVLQLPWWGLLLACLIALGFTLPIGIINATTNQQPGLNVITELIIGFLYPGKPVANVVFKTYGYISMAQALAFLSDFKLGHYMKIPPKSMFIVQLVGTVVASSVYFGTAWWLLGSIKDICDTAALPEGSPWTCPGDDVFYSASIIWGVIGPGKMFTKEGIYPEMNWCFLIGFLAPVPVWLLSRKFPKKRWIKQIHMPIIIGTASSMPTAKAVHFNTWGVVGIFFNYYIYRKYKAWWARHTYILSGALDAGIAFMGVVIYFALQNYDNFGPNWWGLDSGDHCPLAKCPTAPGVKSKGCPVQ

SEQ ID NO: 36 - protein, 756 aa, Citrus sinensis
MGSRNFEEDGVPQALSLEKPQTEIKIIGDEEVNDSPIEQVRLTVPITDDPSQPALTFRTWFLGIISCVVLSFLNRFFGFRQNQLSVGSISAQIIVLPLGKLMAATLPSKPIRVPLTKWTFSMNPGPFNLKEHVLITIFANCGAGGVYAVYIITIVKAFYKRKLNPLAAMLLAQTTQLLGYGWAGLFRKYLVDSPFMWWPANLVQVSLFRALHEKEKRPKGGLTRLQFFFMVFASSFAYYVVPGYLFPTLSALSFVCWIWKNSVTAQQIGAGLNGLGIGSFGLDWSTVASFLGSPLASPVFAIINVLAGFILNLYVLVPIAYWTNTYEAKRFPIFSSHTFDSTGQPYNISRILNEATFDLDHDAFNSYSKLYLSPFFAFNYGLSFATLTATISHVALFDGSDIWQMWKRTTSAARDKFADVHTRLMKKHYEAVPQWWFHIILVATVALSIYACEGFDKQLQLPWWGILLACAIALFFTLPIGIIQATTNQQPGLNVITELIIGYMYPGRPLANVAFKTYGYISMSQALSFLADFKLGHYMKIPPKSMFLVQLIGTVVASSVYFGTAWWLLTSVEHICDPSALPEGSPWTCPGDDVFYSASIIWGIVGPGKMFTKEGVYPALNWFFLVGLLAPVPIWFLSRKFPEIKWIRLIHIPIIFGGTGNMPPARAVHYLSWAAVGIFFNYYVYRRFKGWWARHTYILSAALDAGVAFMGVFLFLTLQSYDIFGPHWWGLDSTDHCPLATCPTAPGIVIEGCPVF

SEQ ID NO: 37 - protein, 756 aa, Citrus clementina
MGSRNIEEDGVPQALSLEKPQTEIKIIGDEEVNDSPIEQVRLTVPITDDPSQPALTFRTWFLGIISCVVLSFLNRFFGFRQNQLSVGSISAQIIVLPLGKLMAATLPSKPIRVPLTKWTFSMNPGPFNLKEHVLITIFANCGAGGVYAVYIITIVKAFYKRKLNPLAAMLLAQTTQLLGYGWAGLFRKYLVDSPFMWWPANLVQVSLFRALHEKEKRPKGGLTRLQFFFMVFASSFAYYVVPGYLFPTLSALSFVCWIWKNSVTAQQIGAGLNGLGIGSFGLDWSTVASFLGSPLASPVFAIINVLAGFILNLYVLVPIAYWTNTYEAKRFPIFSSHTFDSTGQPYNISRILNEATFDLDHDAFNSYSKLYLSPFFAFNYGLSFATLTATISHVALFDGSDIWQMWKRTTSAARDKFADVHTRLMKKHYEAVPQWWFHIILVATVALSIYACEGFDKQLQLPWWGILLACAIALFFTLPIGIIQATTNQQPGLNVITELIIGYMYPGRPLANVAFKTYGYISMSQALSFLADFKLGHYMKIPPKSMFLVQLIGTVVASSVYFGTAWWLLTSVEHICDPSALPEGSPWTCPGDDVFYSASIIWGIVGPGKMFTKEGVYPALNWFFLVGLLAPVPIWFLSRKFPEIKWIGLIHIPIILGGTGNMPPARAVHYLSWAAVGIFFNYYVYRRFKGWWARHTYILSAALDAGVAFMGVFLFLTLQSYDIFGPHWWGLDSTDHCPLATCPTAPGIVIEGCPVF

SEQ ID NO: 38 - protein, 754 aa, Citrus clementina
MGSYDEDGVTKTKALEKHQTDIDVNGGEEVNDNPIEEVRLTVPITDDPSQPVLTFRTWILGITSCGLLAFVNQFFGYRQNQLSVGSVSAQILVLPIGKLMAATLPTKQMRVPFTKWSFSLNPGPFNLKEHVLITIFAGCGASGVYAVNIITIVKAFYNRSLHPVAAMLLVQTTQLLGYGWAGIFRKYLVDSPYMWWPSNLVQVSLFRALHEKERRPKGGLTRLQFFLLVFVSSFGYYIIPGYLFPSLSALSFVCLIWKDSITAQKLGSGQHGLGIGSFGLDWSTVAGFLGSPLATPFFAIANILAGYFLFLYVLVPIAYWSNAFEAKKFPLFSSKTFDSDGQVYNITRILNDKAFDLNEIGYRNYSKLYVSVIFAYIYGLSFATLMASISHVALFEGKTIWEMWKKTATAVNDKFGDVHTRLMKKNYEAVPQWWFQAILVLTFALSLYACEGFGKQLQLPWWGLLLACGMAFFFTLPVGVIQATTNLQTGLNVITELVIGYMYPGKPLANVTFKTYGYISMSQALSFLGDFKLGHYMKVPPKSMFIVQLVGTLVASTAYFGTAWWLLTSIDHICNPSLLPEGSPWTCPGDEVFYNASIIWGVVGPLRMFTNYGNYPQMNWFFLIGFLAPFPGWLLSRKFPEKKWIKNIHMPILLGGPLNLPSAKAVNYTSWAAVGIFFNYYVFRRYKGWWARHNYILSAALDAGVAFMAIMIYFALQSNDIFGPQWWGLDSTDHCPLAKCPIAPGIKADGCPVL

SEQ ID NO: 39 - protein, 754 aa, Citrus sinensis
MGSFDEDGVTKTKALEKHQTDIDVNGGEEVNDNPIEEVRLTVPITDDPSQPVLTFRTWILGITSCGLLAFVNQFFGYRQNQLSVGSVSAQILVLPIGKLMAATLPTKQMRVPFTKWSFSLNPGPFNLKEHVLITIFAGCGASGVYAVNIITIVKAFYNRSLHPVAAMLLVQTTQLLGYGWAGIFRKYLVDSPYMWWPSNLVQVSLFRALHEKERRPKGGLTRLQFFLLVFVSSFGYYIIPGYLFPSLSALSFVCLIWKDSITAQKLGSGQHGLGIGSFGLDWSTVAGFLGSPLATPFFAIANILAGYFLFLYVLVPIAYWSNAFEAKKFPLFSSKTFDSDGQVYNITRILNDKAFDLNEIGYRNYSKLYVSVIFAYIYGLSFATLMASISHVALFEGKTIWEMWKKTAAAVNDKFGDVHTRLMKKNYEAVPQWWFQAILVLTFALSLYACEGFGKQLQLPWWGLLLACGMAFFFTLPVGVIQATTNLQTGLNVITELVIGYMYPGKPLANVTFKTYGYISMSQALSFLGDFKLGHYMKVPPKSMFIVQLVGTLVASTAYFGTAWWLLTSIDHICNPSLLPEGSPWTCPGDEVFYNASIIWGVVGPLRMFTNYGNYPQMNWFFLIGFLAPFPGWLLSRKFPEKKWIKNIHMPILLGGPLNLPSAKAVNYTSWAAVGIFFNYYVFRRYKGWWARHNYILSAALDAGVAFMAIMIYFALQSNDIFGPQWWGLDSTDHCPLAKCPIAPGIKADGCPVL

SEQ ID NO: 40 - protein, 754 aa, Citrus unshiu
MGSFDEDGVTKTKALEKHQTDIDVNGGEEVNDNPIEEVRLTVPITDDPSQPVLTFRTWILGITSCGLLAFVNQFFGYRQNQLSVGSVSAQILVLPIGKLMAATLPTKQMRVPFTKWSFSLNPGPFNLKEHVLITIFAGCGASGVYAVNIITIVKAFYNRSLHPVAAMLLVQTTQLLGYGWAGIFRKYLVDSPYMWWPSNLVQVSLFRALHEKERRPTGGLTRLQFFLLVFVSSFGYYIIPGYLFPSLSALSFVCLIWKDSITAQKLGSGQHGLGIGSFGLDWSTVAGFLGSPLATPFFAIANILAGYFLFLYVLVPIAYWSNAFEAKKFPLFSSKTFDSDGQVYNITRILNDKAFDLNEIGYRNYSKLYVSVIFAYIYGLSFATLMASISHVALFEGKTIWEMWKKTAAAVNDKFGDVHTRLMKKNYEAVPQWWFQAILVLTFALSLYACEGFGKQLQLPWWGLLLACGMAFFFTLPVGVIQATTNLQTGLNVITELVIGYMYPGKPLANVTFKTYGYISMSQALSFLGDFKLGHYMKVPPKSMFIVQLVGTLVASTAYFGTAWWLLTSIDHICNPSLLPEGSPWTCPGDEVFYNASIIWGVVGPLRMFTNYGNYPQMNWFFLIGFLAPFPGWLLSRKFPEKKWIKNIHMPILLGGPLNLPSAKAVNYTSWAAVGIFFNYYVFRRYKGWWARHNYILSAALDAGVAFMAIMIYFALQSNDIFGPQWWGLDSTDHCPLAKCPIAPGIKADGCPVL

SEQ ID NO: 41 - protein, 728 aa, Citrus sinensis
MEEANDNPIEEVRLTVPITDDPTIPALTFRTWVLGLTSCCLLAFVNQFFGYRQNQLYLSSISAQILVLPIGKLMAATLPSKPIPVPLTPWSFSLNPGPFNLKEHVLITIFAGCGSSGVYAVGIITIVKAFYKRSLHVVPAMMLVQTTQLLGYGWAGLFRKYLVDSPYMWWPANLVQVSLFRALHEEEKRTKGGLTRLQFFVIVFISSFAYYVVPGYLFPSISALSFVCWIWKDSVTAQKLGSGLQGLGMGSFGLDWATVAGFLGSPLATPFFAIANILVGFFLFLYILIPIAYWCNAFEAQRFPLFSSHTFDSDGQIYNVSRILNEKEFSFDREAYDNYSRLYLSVLFAFIYGLGFATLMASISHVALFEGKTIWQMWRKTTAAVKQQFGDVHTRLMKKNYEAVPQWWFHAILIITFALSLFTCEGFDKQFQLPWWGLLLACAMAFFFTLPVGVIQATTNLQPGLNIITEMVIGYMYPGKPLANVAFKTYGYISMVQALGFLGDFKLGHYMKVPPKSMFVVQLVGTIVASTVYFGTAWWLLTSVEHICNPSLLPEGSPWTCPGDDVFYNASIIWGVVGPLRMFTNYGNYPQMNWFFLIGFLAPFPVWLLSRKFPEKKWIKNIHMPLLLAGPGSLPSAKAVNYLSWGAVGIFFNYYVYRRFKGWWARHTYILSAALDAGVAFMGVFLYFTLQSQDIFGPEWWGLAATDHCPLAKCPIAPGIKVQGCPVA

SEQ ID NO: 42 - protein, 773 aa, Citrus sinensis
MRVSHSAMSFTFQFKDRDMGTYVEGGMLQSMSPENSQTDTRTKGDMEEANDNPIEEVRLTVPITDDPTIPALTFRTWVLGLTSCCLLAFVNQFFGYRQNQLYLSSISAQILVLPIGKLMAATLPSKPIPVPLTPWSFSLNPGPFNLKEHVLITIFAGCGSSGVYAVGIITIVKAFYKRSLHVVPAMMLVQTTQLLGYGWAGLFRKYLVDSPYMWWPANLVQVSLFRALHEEEKRTKGGLTRLQFFVIVFISSFAYYVVPGYLFPSISALSFVCWIWKDSVTAQKLGSGLQGLGMGSFGLDWATVAGFLGSPLATPFFAIANILVGFFLFLYILIPIAYWCNAFEAQRFPLFSSHTFDSDGQIYNVSRILNEKEFSFDREAYDNYSRLYLSVLFAFIYGLGFATLMASISHVALFEGKTIWQMWRKTTAAVKQQFGDVHTRLMKKNYEAVPQWWFHAILIITFALSLFTCEGFDKQFQLPWWGLLLACAMAFFFTLPVGVIQATTNLQPGLNIITEMVIGYMYPGKPLANVAFKTYGYISMVQALGFLGDFKLGHYMKVPPKSMFVVQLVGTIVASTVYFGTAWWLLTSVEHICNPSLLPEGSPWTCPGDDVFYNASIIWGVVGPLRMFTNYGNYPQMNWFFLIGFLAPFPVWLLSRKFPEKKWIKNIHMPLLLAGPGGLPSAKAVNYLSWGAVGIFFNYYVYRRFKGWWARHTYILSAALDAGVAFMGVFLYFTLQSQDIFGPEWWGLAATDHCPLAKCPIAPGIKVQGCPVA

SEQ ID NO: 43 - protein, 773 aa, Citrus clementina
MCVSHSAISFTFMFMDRDMGTYVEGGMLQSMSPENSQTDTRTKGDMEEANDNPIEEVRLTVPITDDPTIPALTFRTWVLGLTSCCLLAFVNQFFGYRQNQLYLSSISAQILVLPIGKLMAATLPSKPIPVPLTPWSFSLNPGPFNLKEHVLITIFAGCGSSGVYAVSIITIVKAFYKRSLHVVPAMMLVHTTQLLGYGWAGLFRKYLVDSPYMWWPANLVQVSLFRALHEEEKRTKGGLTRLQFFVIVFISSFAYYVVPGYLFPSISALSFVCWIWKDSVTAQKLGSGLQGLGMGSFGLDWATVAGFLGSPLATPFFAIANILVGFFLFLYILIPIAYWCNAFEAQRFPLFSSHTFDYDGQIYNVSRILNEKEFSFDREAYDNYSRLYLSVLFAFIYGLGFATLMASISHVALFEGKTIWQMWRKTTAAVKQQFGDVHTRLMKKNYESVPQWWFHAILILTFALSLFTCEGFDKQFQLPWWGLLLACAMAFFFTLPVGVIQATTNLQPGLNIITEMVIGYMYPGKPLANVAFKTYGYISMVQALGFLGDFKLGHYMKVPPKSMFVVQLVGTIVASTVYFGTAWWLLTSVEHICNPSLLPEGSPWTCPGDDVFYNASIIWGVVGPLRMFTNYGNYPQMNWFFLIGFLAPFPVWLLSRKFPEKKWIKNIHMPLLLAGPGSLPSAKAVNYLSWGAVGIFFNYYVYRRFKGWWARHTYILSAALDAGVAFMGVFLYFTLQSQGIFGPDWWGLAATDHCPLAKCPIAPGIKVKGCPVA

SEQ ID NO: 44 - protein, 755 aa, Citrus clementina
MGTYVEGGMLQSMSPENSQTDTRTKGDMEEANDNPIEEVRLTVPITDDPTIPALTFRTWVLGLTSCCLLAFVNQFFGYRQNQLYLSSISAQILVLPIGKLMAATLPSKPIPVPLTPWSFSLNPGPFNLKEHVLITIFAGCGSSGVYAVSIITIVKAFYKRSLHVVPAMMLVHTTQLLGYGWAGLFRKYLVDSPYMWWPANLVQVSLFRALHEEEKRTKGGLTRLQFFVIVFISSFAYYVVPGYLFPSISALSFVCWIWKDSVTAQKLGSGLQGLGMGSFGLDWATVAGFLGSPLATPFFAIANILVGFFLFLYILIPIAYWCNAFEAQRFPLFSSHTFDYDGQIYNVSRILNEKEFSFDREAYDNYSRLYLSVLFAFIYGLGFATLMASISHVALFEGKTIWQMWRKTTAAVKQQFGDVHTRLMKKNYESVPQWWFHAILILTFALSLFTCEGFDKQFQLPWWGLLLACAMAFFFTLPVGVIQATTNLQPGLNIITEMVIGYMYPGKPLANVAFKTYGYISMVQALGFLGDFKLGHYMKVPPKSMFVVQLVGTIVASTVYFGTAWWLLTSVEHICNPSLLPEGSPWTCPGDDVFYNASIIWGVVGPLRMFTNYGNYPQMNWFFLIGFLAPFPVWLLSRKFPEKKWIKNIHMPLLLAGPGSLPSAKAVNYLSWGAVGIFFNYYVYRRFKGWWARHTYILSAALDAGVAFMGVFLYFTLQSQGIFGPDWWGLAATDHCPLAKCPIAPGIKVKGCPVA

SEQ ID NO: 45 - protein, 728 aa, Citrus clementina
MEEANDNPIEEVRLTVPITDDPTIPALTFRTWVLGLTSCCLLAFVNQFFGYRQNQLYLSSISAQILVLPIGKLMAATLPSKPIPVPLTPWSFSLNPGPFNLKEHVLITIFAGCGSSGVYAVSIITIVKAFYKRSLHVVPAMMLVHTTQLLGYGWAGLFRKYLVDSPYMWWPANLVQVSLFRALHEEEKRTKGGLTRLQFFVIVFISSFAYYVVPGYLFPSISALSFVCWIWKDSVTAQKLGSGLQGLGMGSFGLDWATVAGFLGSPLATPFFAIANILVGFFLFLYILIPIAYWCNAFEAQRFPLFSSHTFDYDGQIYNVSRILNEKEFSFDREAYDNYSRLYLSVLFAFIYGLGFATLMASISHVALFEGKTIWQMWRKTTAAVKQQFGDVHTRLMKKNYESVPQWWFHAILILTFALSLFTCEGFDKQFQLPWWGLLLACAMAFFFTLPVGVIQATTNLQPGLNIITEMVIGYMYPGKPLANVAFKTYGYISMVQALGFLGDFKLGHYMKVPPKSMFVVQLVGTIVASTVYFGTAWWLLTSVEHICNPSLLPEGSPWTCPGDDVFYNASIIWGVVGPLRMFTNYGNYPQMNWFFLIGFLAPFPVWLLSRKFPEKKWIKNIHMPLLLAGPGSLPSAKAVNYLSWGAVGIFFNYYVYRRFKGWWARHTYILSAALDAGVAFMGVFLYFTLQSQGIFGPDWWGLAATDHCPLAKCPIAPGIKVKGCPVA

SEQ ID NO: 46 - protein, 675 aa, Citrus clementina
METAFSASMGTEVEVSEPLIEKITAEEDQLIPEWKDQITIRGLAVSAIMGTLFCIITHRLNLTVGIIPSLNIAAGLLGFLSVKSWTSFLSKLGFSTKPFTRQENTVIQTCVVACYGLAASGGFGSSFLAMDKRTYKLIGTEYPGNRAEDVKNPGLGWMIVFMFVVSFVGLFSLVALRKVMILDGKLTYPSGTATAVLINGFHTNAGAELAGMQVRCIGKYLSISFLCSSFKWFFSGVGDSCGFDNFPSFGLILFKNTFYFDFSPTYVGCGLICPRIVNCSVLLGAIVSWGFLWPYISQHAGDWYPADLGNSDFKGLYGYKVFIAISLILGDGLYNLIKIISVTFKELCNKRTKVSKLPIDNEIQDTESSRLLIDQKKRENVFLKDGIPTWFAASGYVGLAAISTATIPTIFPPLKWYLVLLLYLIAPALAFCNSYGAGLTDCSLSLTYAKIGLFIIASLVGTNGGVIAGLAACGVMMSIVSTAADLMQDFKTGYLTLSSAKSMFVSQLLGTAMGCVFAPLTFWMYWTAFDIGSPDGPYKAPYAVILREMAILGIEGFSELPKHCLALCCGFFVAALVINLLRDVIPEKISKFIPVPMAMAIPFFVGAYLAIDMFVGTVILFIWERINRKDSEDYAGAVASGLICGDGIWTMPSAVLSIFSINPPICMYFGPTVSS

SEQ ID NO: 47 - protein, 667 aa, Citrus clementina
MGTEVEVSEPLIEKITAEEDQLIPEWKDQITIRGLAVSAIMGTLFCIITHRLNLTVGIIPSLNIAAGLLGFLSVKSWTSFLSKLGFSTKPFTRQENTVIQTCVVACYGLAASGGFGSSFLAMDKRTYKLIGTEYPGNRAEDVKNPGLGWMIVFMFVVSFVGLFSLVALRKVMILDGKLTYPSGTATAVLINGFHTNAGAELAGMQVRCIGKYLSISFLCSSFKWFFSGVGDSCGFDNFPSFGLILFKNTFYFDFSPTYVGCGLICPRIVNCSVLLGAIVSWGFLWPYISQHAGDWYPADLGNSDFKGLYGYKVFIAISLILGDGLYNLIKIISVTFKELCNKRTKVSKLPIDNEIQDTESSRLLIDQKKRENVFLKDGIPTWFAASGYVGLAAISTATIPTIFPPLKWYLVLLLYLIAPALAFCNSYGAGLTDCSLSLTYAKIGLFIIASLVGTNGGVIAGLAACGVMMSIVSTAADLMQDFKTGYLTLSSAKSMFVSQLLGTAMGCVFAPLTFWMYWTAFDIGSPDGPYKAPYAVILREMAILGIEGFSELPKHCLALCCGFFVAALVINLLRDVIPEKISKFIPVPMAMAIPFFVGAYLAIDMFVGTVILFIWERINRKDSEDYAGAVASGLICGDGIWTMPSAVLSIFSINPPICMYFGPTVSS

SEQ ID NO: 48 - protein, 686 aa, Citrus unshiu
METAFSASMGTEVEVSEPLIEKITAEEDQLIPEWKDQITIRGLAVSAIMGTLFCIITHRLNLTVGIIPSLNIAAGLLGFLSVKSWTSFLSKLGFSTKPFTRQENTVIQTCVVAFMASLLAFDVIINMQLSTGGFGSSFLAMDERTYKLIGTEYPGNRAEDVKNPGLGWMIVFMFVVSFVGLFSLVALRKVMILDGKLTYPSGTATAVLINGFHTNAGAELAGMQVRCIGKYLSISFLCSSFKWFFSGVGDSCGFDNFPSFGLILFKNTFYFDFSPTYVGCGLICPRIVNCSVLLRAIVSWGFLWPYISQHAGDWYPADLGNSDFKGLYGYKVFIAISLILGDGLYNLIKIISVTFKELCNKRTKVSKLPIDNEIQDTESSRLLIEQKKRENVFLKDGIPTWFAASGYVGLAAISTATIPTIFPPLKWYLVLLLYLIAPALAFCNSYGAGLTDCSLSLTYAKIGLFIIASLVGTNGGVIAGLAACGVMMSIVSTAADLMQDFKTGYLTLSSAKSMFVSQLLGTAMGCVFAPLTFWMYWTAFDIGSPDGPYKAPYAVILREMAILGIEGFSELPKHCLALCCGFFVAALVINLLRDVIPEKISKFIPVPMAMAIPFFVGAYLAIDMFVGTVILFIWERINRKDSEDYAGAVASGLICGDGIWTMPSAVLSIFSINPPICMYFGPTVSS

SEQ ID NO: 49 - protein, 673 aa, Citrus clementina
MGTEVEVSEPLIEKIAAVNDEEEEADQPIPEWKDQITIRGLVASAIMGTLFCIITHKLNLTVGIIPSLNVAAGLLGFFLVKSWTSFLSKLGFSIKPFTRQENTVIQTCVVACYGLAFSGGFGSSLLAMDERTYQLIGADYPGNRAEDVKNPGLGWMIGFVVVVSFLGLFSLVPLRKVMILDYKLTYPSGTATAMLINSFHTNTGAELAGKQVRCLGKYLSISFFWSCFKWFFSGVGNSCGFDNFPSFGLTLFKNTFYFDFSPTYVGCGLICPHIVNCSVLLGAIISWGFLWPFISQHAGDWYPADLGSNDFKGLYGYKVFIAISLILGDGLYNLIKIITITVKEMWNRSTKDSKLPFVNDIQDTETSKLLLEQKKREIVFLKDGIPTWFAASGYVGLAAISTATIPTIFPPLKWYLVLCSYLIAPALAFCNSYGTGLTDWNLASTYGKIGLFIIASLVGTDGGVIAGLAACGVMMSIVSTAADLMQDFKTGYLTLSSAKSMFVSQLLGTAMGCVIAPLTFWMYWTAFDIGSPDGPYKAPYAVIFREMAILGIEGFSELPKHCLALCCGFFVAALVINLLRDATPTKISQFIPVPMAMAVPFYIGAYFAIDMFVGTVILFIWELVNRKDSEDYAGAVASGLICGDGIWTIPSAILSIFRVNPPVCMYFGPAVGS

SEQ ID NO: 50 - protein, 673 aa, Citrus sinensis
MGTEVEVSEPLIEKIAAVNDEEEEADQPIPEWKDQITIRGLVASAIMGTLFCIITHKLNLTVGIIPSLNVAAGLLGFFLVKSWTSFLSKLGFSIKPFTRQENTVIQTCVVACYGLAFSGGFGSSLLAMDERTYQLIGADYPGNRAEDVKNPGLGWMIGFVVVVSFLGLFSLVPLRKVMILDYKLTYPSGTATAMLINSFHTNTGAELAGKQVRCLGKYLSISFFWSCFKWFFSGVGNSCGFDNFPSFGLTLFKNTFYFDFSPTYVGCGLICPHIVNCSVLLGAIISWGFLWPFISQHAGDWYPADLGSNDFKGLYGYKVFIAISLILGDGLYNLIKIITITVKEMWNRSTKDSKLPFVNDIQDTETSKLLLEQKEREIVFLKDGIPTWFAASGYVGLAAISTATIPTIFPPLKWYLVLCSYLIAPALAFCNSYGTGLTDWNLASTYGKIGLFIIASLVGTDGGVIAGLAACGVMMSIVSTAADLMQDFKTGYLTLSSAKSMFVSQLLGTAMGCVIAPLTFWMYWTAFDIGSPDGPYKAPYAVIFREMAILGIEGFSELPKHCLALCCGFFVAALVINLLRDATPTKISRFIPVPMAMAVPFYIGAYFAIDMFVGTVILFIWELVNRKDSEDYAGAVASGLICGDGIWTIPSAILSIFRVNPPVCMYFGPAVGS

SEQ ID NO: 51 - protein, 673 aa, Citrus unshiu
MGTEVEVSEPLIEKIAAVNDEEEEADQPIPEWKDQITIRGLVASAIMGTLFCIITHKLNLTVGIIPSLNVAAGLLGFFLVKSWTSFLSKLGFSIKPFTRQENTVIQTCVVACYGLAFSGGFGSSLLAMDERTYQLIGADYPGNRAEDVKNPGLGWMIGFVVVVSFLGLFSLVPLRKVMILDYKLTYPSGTATAMLINSFHTNTGAELAGKQVRCLGKYLSISFFWSCFKWFFSGVGNSCGFDNFPSFGLTLFKNTFYFDFSPTYVGCGLICPHIVNCSVLLGAIISWGFLWPFISQHAGDWYPADLGSNDFKGLYGYKVFIAISLILGDGLYNLIKIIAITVKEMWNRSTKDSKLPFVNDIQDTETSKLLLEQKKREIVFLKDGIPTWFAASGYVGLAAISTATIPTIFPPLKWYLVLCSYLIAPALAFCNSYGTGLTDWNLASTYGKIGLFIIASLVGTDGGVIAGLAACGVMMSIVSTAADLMQDFKTGYLTLSSAKSMFVSQLLGTAMGCVIAPLTFWMYWTAFDIGSPDGPYKAPYAVIFREMAILGIEGFSELPKHCLALCCGFFVAALVINLLRDATPTKISQFIPVPMAMAVPFYIGAYFAIDMFVGTVILFIWELVNQKDSEDYAGAVASGLICGDGIWTIPSAILSIFRVNPPVCMYFGPAVGS

SEQ ID NO: 52 - protein, 602 aa, Citrus unshiu
MGTEVEVSEPLIEKITAEEDQLIPEWKDQITIRGLAFDVIINMQLSTGGFGSSFLAMDERTYKLIGTEYPGNRAEDVKNPGLGWMIVFMFVVSFVGLFSLVALRKVMILDGKLTYPSGTATAVLINGFHTNAGAELAGMQVRCIGKYLSISFLCSSFKWFFSGVGDSCGFDNFPSFGLILFKNTFYFDFSPTYVGCGLICPRIVNCSVLLRAIVSWGFLWPYISQHAGDWYPADLGNSDFKGLYGYKVFIAISLILGDGLYNLIKIISVTFKELCNKRTKVSKLPIDNEIQDTESSRLLIEQKKRENVFLKDGIPTWFAASGYVGLAAISTATIPTIFPPLKWYLVLLLYLIAPALAFCNSYGAGLTDCSLSLTYAKIGLFIIASLVGTNGGVIAGLAACGVMMSIVSTAADLMQDFKTGYLTLSSAKSMFVSQLLGTAMGCVFAPLTFWMYWTAFDIGSPDGPYKAPYAVILREMAILGIEGFSELPKHCLALCCGFFVAALVINLLRDVIPEKISKFIPVPMAMAIPFFVGAYLAIDMFVGTVILFIWERINRKDSEDYAGAVASGLICGDGIWTMPSAVLSIFSINPPICMYFGPTVSS

SEQ ID NO: 53 - protein, 560 aa, Citrus unshiu
MQLSTGGFGSSFLAMDERTYKLIGTEYPGNRAEDVKNPGLGWMIVFMFVVSFVGLFSLVALRKVMILDGKLTYPSGTATAVLINGFHTNAGAELAGMQVRCIGKYLSISFLCSSFKWFFSGVGDSCGFDNFPSFGLILFKNTFYFDFSPTYVGCGLICPRIVNCSVLLRAIVSWGFLWPYISQHAGDWYPADLGNSDFKGLYGYKVFIAISLILGDGLYNLIKIISVTFKELCNKRTKVSKLPIDNEIQDTESSRLLIEQKKRENVFLKDGIPTWFAASGYVGLAAISTATIPTIFPPLKWYLVLLLYLIAPALAFCNSYGAGLTDCSLSLTYAKIGLFIIASLVGTNGGVIAGLAACGVMMSIVSTAADLMQDFKTGYLTLSSAKSMFVSQLLGTAMGCVFAPLTFWMYWTAFDIGSPDGPYKAPYAVILREMAILGIEGFSELPKHCLALCCGFFVAALVINLLRDVIPEKISKFIPVPMAMAIPFFVGAYLAIDMFVGTVILFIWERINRKDSEDYAGAVASGLICGDGIWTMPSAVLSIFSINPPICMYFGPTVSS

SEQ ID NO: 54 - protein, 546 aa, Citrus sinensis
MDKRTYKLIGTEYPGNRAEDVKNPGLGWMIVFMFVVSFVGLFSLVALRKVMILDGKLTYPSGTATAVLINGFHTNAGAELAGMQVRCIGKYLSISFLCSSFKWFFSGVGDSCGFDNFPSFGLILFKNTFYFDFSPTYVGCGLICPRIVNCSVLLGAIVSWGFLWPYISQHAGDWYPADLGNSDFKGLYGYKVFIAISLILGDGLYNLIKIISVTFKELCNKRTKVSKLPIDNEIQDTESSRLLIDQKKRENVFLKDGIPTWFAASGYVGLAAISTATIPTIFPPLKWYLVLLLYLIAPALAFCNSYGAGLTDCSLSLTYAKIGLFIIASLVGTNGGVIAGLAACGVMMSIVSTAADLMQDFKTGYLTLSSAKSMFVSQLLGTAMGCVFAPLTFWMYWTAFDIGSPDGPYKAPYAVILREMAILGIEGFSELPKHCLALCCGFFVAALVINLLRDVIPEKISKFIPVPMAMAIPFFVGAYLAIDMFVGTVILFIWERINRKDSEDYAGAVASGLICGDGIWTMPSAVLSIFSINPPICMYFGPTVSS

SEQ ID NO: 55 - protein, 585 aa, Citrus clementina
MDPMSFCLHFIFLVIELLEFDVIMDTQLPSGGFGSSLLAMDERTYQLIGADYPGNRAEDVKNPGLGWMIGFVVVVSFLGLFSLVPLRKVMILDYKLTYPSGTATAMLINSFHTNTGAELAGKQVRCLGKYLSISFFWSCFKWFFSGVGNSCGFDNFPSFGLTLFKNTFYFDFSPTYVGCGLICPHIVNCSVLLGAIISWGFLWPFISQHAGDWYPADLGSNDFKGLYGYKVFIAISLILGDGLYNLIKIITITVKEMWNRSTKDSKLPFVNDIQDTETSKLLLEQKKREIVFLKDGIPTWFAASGYVGLAAISTATIPTIFPPLKWYLVLCSYLIAPALAFCNSYGTGLTDWNLASTYGKIGLFIIASLVGTDGGVIAGLAACGVMMSIVSTAADLMQDFKTGYLTLSSAKSMFVSQLLGTAMGCVIAPLTFWMYWTAFDIGSPDGPYKAPYAVIFREMAILGIEGFSELPKHCLALCCGFFVAALVINLLRDATPTKISQFIPVPMAMAVPFYIGAYFAIDMFVGTVILFIWELVNRKDSEDYAGAVASGLICGDGIWTIPSAILSIFRVNPPVCMYFGPAVGS

SEQ ID NO: 56 - protein, 518 aa, Citrus sinensis
MIGLFILLGINFSFFSSVLYQVMILDYKLTYPSGTATAMLINSFHTNTGAELAGKQVRCLGKYLSISFFWSCFKWFFSGVGNSCGFDNFPSFGLTLFKNTFYFDFSPTYVGCGLICPHIVNCSVLLGAIISWGFLWPFISQHAGDWYPADLGSNDFKGLYGYKVFIAISLILGDGLYNLIKIITITVKEMWNRSTKDSKLPFVNDIQDTETSKLLLEQKEREIVFLKDGIPTWFAASGYVGLAAISTATIPTIFPPLKWYLVLCSYLIAPALAFCNSYGTGLTDWNLASTYGKIGLFIIASLVGTDGGVIAGLAACGVMMSIVSTAADLMQDFKTGYLTLSSAKSMFVSQLLGTAMGCVIAPLTFWMYWTAFDIGSPDGPYKAPYAVIFREMAILGIEGFSELPKHCLALCCGFFVAALVINLLRDATPTKISRFIPVPMAMAVPFYIGAYFAIDMFVGTVILFIWELVNRKDSEDYAGAVASGLICGDGIWTIPSAILSIFRVNPPVCMYFGPAVGS

SEQ ID NO: 57 - protein, 673 aa, Citrus trifoliata
MGTEVEVSEPLIENIAAVNDEEEEADQPIPEWKDQITIRGLVASAIMGTLFCIITHKLNLTVGIIPSLNVAAGLLGFFLVKSWTSFLSKLGFSIKPFTRQENTVIQTCVVACYGLAFSGGFGSSLLAMDERTYQLIGADYPGNRAEDVKNPGLGWMIGFLVVVSFLGLFSLVPLRKVMILDYKLTYPSGTATAMLINSFHTNTGAELAGKQVRCLGKYLSISFFWSCFKWFFSGVGNSCGFDNFPSFGLTLFKNTFYFDFSPTYVGCGLICPHIVNCSVLLGAIISWGLLWPFISQHAGDWYSADLGSNDFKGLYGYKVFIAISLILGDGLYNLIKIIAITVKEMWNRSTKDSKLPIVNDIQDTETSKLLLEQKKREIVFLKDGIPTWFAASGYVGLAAISTATIPIIFPPLKWYLVLCSYLIAPALAFCNSYGTGLTDWSLASTYGKIGLFIIASLVGTDGGVIAGLAACGVMMSIVSTAADLMQDFKTGYLTLSSAKSMFVSQLLGTAMGCVIAPLTFWMYWTAFDIGSPDGPYKAPYAVIFREMAILGIEGFSELPKHCLALCCGFFVAALVINLLRDVTPTKISQFIPVPMAMAVPFYIGAYFAIDMFVGTVILFIWELVNRKDSEDYAGAVASGLICGDGIWTIPSAILSIFRVNPPICMYFGPAVGS

SEQ ID NO: 58 - protein, 418 aa, Citrus trifoliata
MPGSLEPLDLSVQIPYHFRCPISLELMCDPVTVCTGQTYDRPSIESWVATGNTTCPVTRSPLTDFTLIPNHTLRRLIQDWCVANRSFGVQRIPTPKQPAEPSLVRTLLSQASSESNTYGSRLSALRRLRGLARDSDKNRSLISSHNVRAVLSQVFFTNINVNTASSPELAHESLALLVMFPLTETECMEIASDADKITSLSSLLFHSSIEVRVNSAALIEIVLAGMRSQELRTQISNVDEIFEGVIDILKNLSSYPRGLKVGIKALFALCLVKQTRHKAVAAGAAETLVDRLADFDKCDAERALATVELLCRIPAGCAAFAEHALTVPLLVKTILKISDRATEYAAGALAALCSASERCQRDAVSAGVLTQLLLLVQSDCTDRAKRKAQLLLKLLRDSWPQDSIGNSDDFACSEVVPF

SEQ ID NO: 59 - protein, 418 aa, Citrus clementina
MPGSLEPLDLSVQIPYHFRCPISLELMCDPVTVCTGQTYDRPSIESWVATGNTTCPVTRSPLTDFTLIPNHTLRRLIQDWCVANRSFGVQRIPTPKQPAEPSLVRTLLNQASSESNTYGSRMSALRRLRGLARDSDKNRCLISSHNVRAILSQVFFTNINVNTASSPELAHESLALLVMFPLTETECMEIASDADKITSLSSLLFHSSIEVRVNSAALIEIVLAGMRSQELRAQISNLDEIFEGVIDILKNLSSYPRGLKVGIKALFALCLVKQTRHKAVAAGAAETLVDRLADFDKCDAERALATVELLCRIPAGCAEFAEHALTVPLLVKTILKISDRATEYAAGALAALCSASERCQRDAVSAGVLTQLLLLVQSDCTDRAKRKAQLLLKLLRDSWPQDSIGNSDDFACSEVVPF

SEQ ID NO: 60 - protein, 418 aa, Citrus sinensis
MPGSLEPLDLSVQIPYHFRCPISLELMCDPVTVCTGQTYDRPSIESWVATGNTTCPVTRSPLTDFTLIPNHTLRRLIQDWCVANRSFGVQRIPTPKQPAEPSLVRTLLNQASSESNTYGSRLSALRRLRGLARDSDKNRSLISSHNVRAILSQVFFTNINVKTASSPELAHESLALLVMFPLTETECMEIASDADKITSLSSLLFHSSIEVRVNSAALIEIVLAGMRSQELRAQISNLDEIFEGVIDILKNLSSYPRGLKVGIKALFALCLVKQTRYKAVAAGAAETLVDRLADFDKCDAERALATVELLCRIPAGCAEFAEHALTVPLLVKTILKISDRATEYAAGALAALCSASERCQRDAVSAGVLTQLLLLVQSDCTDRAKRKAQLLLKLLRDSWPQDSIGNSDDFACSEVVPF

SEQ ID NO: 61 - protein, 418 aa, Citrus cavaleriei
MPGSLEPLDLSVQIPYHFRCPISLELMCDPVTVCTGQTYDRPSIESWVATGNTTCPVTRSPLTDFTLIPNHTLRRLIQDWCVANRSFGVQRIPTPKQPAEPSLVRTLLNQASSESNTYGSRLSALRRLRGLARDSDKNRSLISSHNVRAILSQVFFTNINVNTASSPELAHESLALLVMFPLTETECMEIASDADKITSLSSLLFHSSIEVRVNSAALIEIVLAGMRSQELRAQISNLDEIFEGVIDILKNLSSYPRGLKVGIKALFALCLVKQTRHKAVAAGAAETLVDRLADFDKCDAERALATVELLCRIPAGCAEFAEHALTVPLLVKTILKISDRATEYAAGALAALCSASERCQRDAVSAGVLTQLLLLVQSDCTDRAKRKAQLLLKLLRDSWPQDSIGNSDDFACSEVVPF

SEQ ID NO: 62 - protein, 346 aa, Citrus reticulata
MPGSLEPLDLSVQIPYHFRCPISLELMCDPVTVCTGQTYDRPSIESWVATGNTTCPVTRSPLTDFTLIPNHTLRRLIQDWCVANRSFGVQRIPTPKQPAEPSLVRTLLNQASSESNTYGSRLSALRRLRGLARDSDKNRSLISSHNVRAILSRVFFTNINVNTASSPELAHESLALLVMFPLTETECMEIASDADKITSLSSLLFHSSIEVRVNSAALIEIVLAGMRSQELRAQIMRRGEGAGDGGVTVQDPGGLRRVCGARADGAAAGEDDTEDIGQGDGVRGGGAGGAVLGVGEVPEGRGQRGGVDPAVAVGAERLYGQGQEEGAAAVEATEGFVASGFYWEFR

SEQ ID NO: 63 - protein, 418 aa, Citrus maxima; identical to SEQ ID NO: 60

SEQ ID NO: 64 - protein, 419 aa, Citrus medica
MPGSLEPLDLSVQIPYHFRCPISLELMCDPVTVCTGQTYDRPSIESWVATGNTTCPVTRSPLTDFTLIPNHTLRRLIQDWCVANRSFGVQRIPTPKQPAEPSLVRTLLNQASSESNTYGSRLSALRRLRGLARDSDKNRSLISSHNVRAILSQVFFTNINVNTASSSPELAHESLALLVMFPLTETECMEIASDADKITSLSSLLFHSSIEVRVNSAALIEIVLAGMRSQELRAQISNVDEIFEGVIDILKNLSSYPRGLKVGIKALFALCLVKQTRQKAVAAGAAETLVDRLADFDKCDAERALATVELLCRIPAGCAAFAEHALTVPLLVKTILKISDRATEYAAGALVALCSASERCQRDAVSAGVLTQLLLLVQSDCTDRAKRKAQLLLKLLRDSWPQDSIGNSDDFACSEVVPF

SEQ ID NO: 65 - protein, 415 aa, Solanum lycopersicum
MPASLDPLDVGVQIPYHFRCPISLELMRDPVTVCTGQTYDRQSIESWVATGNTTCPVTRAPLSDFTLIPNHTLRRLIQEWCVANRAFGVERIPTPKQPADPSLVRSLLNQAAAQSNHMNSRVAALRRLRGLARDSEKNRSVISANNAREILLAIVFSRMDSDASELHHESLAILSMFPLSEPECVFVASDPGRVGYLVAMLFHPSIDVRVNSAALIETVVAGMRSPEFRAQISNADDVFEGVVGILNYPLAYPRALKVGIKALFALCLVKQHRQRAVSAGAVEALIDRLQDFEKCDAERALATIELLSRIPSGCAALASHALTVPLLVKIILKISERATEYAAGALLSLCSASEQAQKEAVAAGVLIQLLLLVQSDCTERAKRKAQMLLKQLRDCWPEDSIANTDDFACSDVVPF

SEQ ID NO: 66 - protein, 415 aa, Solanum tuberosum
MPGSLDPLDVGVQIPYHFRCPISLELMRDPVTVCTGQTYDRQSIESWVATGNTTCPVTRAPLSDFTLIPNHTLRRLIQEWCVANRAFGVERIPTPKQPADPSLVRSLLNQAAAQSNHMNSRVAALRRLRGLARDSDKNRSVILANNAREILLAIVFSRMDSDSSELNHESLAILSMFPLSEPECVFVASDPERVSYLVAMLFHPSIDVRVNSAALIEIVVAGMRSPELRAQISNADDVFEGIVGILNYPLAYPRALKVGIKALFALCLVKQHRQRAVTAGAVEALIDRLQDFEKCDAERALATIELLSRIPSGCAALASHALTVPLLVKIILKISERATEYAAGALLSLCSASEQAQKEAVAAGVLIQLLLLVQSDCTERAKRKAQMLLKQLRDCWPEDSIANSDDFACSDVVPF

SEQ ID NO: 67 - protein, 293 aa, Citrus trifoliata
MAAAAITHIKLLLSDLASTLKNVPSDYIRPISDRPNPTDQAHISDGSIPLIDLQGLNGPRRSDIIKQIGQACQHGGFFQVKNHGISEAMINNMLSIARTFFKLPERERLKIYSDDPLKPTRLSTGFNVKTEKASNRRDFLRLHCYPLQDYVHDWPLNPPSFREDVGDYCASVRGLVLRLIEAISESLRLPSDYIDKEALGKQGQHMALNYYPPCPPPELTYGLPGHTDPNLITIHRAVVSRDKERTLVPIIAQNLHLIADVDNEGAGNRIYRNTFAVSEDLQSRDIILKKNSY

SEQ ID NO: 68 - protein, 354 aa, Citrus trifoliata
MSAAATTATKLLLSDLAPTLTNVPSDYIRPISDRPSFTDQTHKSDGSIPLIDLQGLNGPRRSDIIKQIGQACQHCGFFQVKNHGISEAMINNMLSIARTFFKLPESERLKIYSDDPSKPTRLSTSFNVKTEKLSNWRDFLRLHCYPLQDYVHDWPLNPPSFREDVGDYCTSVRGLVLRLIEAISETLGLPSDYIDKEALGKHGQHMALNYYPPCPQPELTYGLPGHTDPNLITILLQDDVPGLQVLRDGNWVPVNPIPSTFIVNIGDQMQVLSNDRYKSVLHRAVVSRDKERISIPTFYCPSPYAVIGPAKGLVDQDHPAVYRDFTYAEYYKKFWNRGLATECCLDMFKASSTV

SEQ ID NO: 69 - protein, 389 aa, Citrus trifoliata
MQLMHRLCIVMRSDSHRLSVNGDEITILISKYNQALRYRPLDMAAATTKLLLSDLASTVKSVPSNYIRPISDRPNLTEVQISDGSIPLIDLQVLDGPRRLDIIKQIGQACQHDGFFQVKNHGIPETIINNMLSIARAFFKLPESERLKSYSDDPSKSTRLSTSFNVNTEKVANWRDYLRLHCYPLQDYIHEWPSTPPSVREVAAEYCTSLRGLVLRLLEAISESLGLQRDFIDKALGKHGQHMALNYYPPCPQPDLTYGLPGHTDPNLITVLLQDDVPGLQVLRNGKWLPVGPIPNTFIVNIGDQMQVLSNDRYKSVLHRALVNCDKERISIPTFYCPSPDAVIAPAKDLIDERHPAVYKNFTYAEYYRKFWNRGLDERCLDLFKASTA

SEQ ID NO: 70 - protein, 368 aa, Citrus trifoliata
MQLVHQFMRPDGHRLSVNSDEITILSSKYNQALRYRPLDIAAATTKLLLSDLASTVKSVPSNYIRPISDRPNLTEVQISDGSIPLIDLQVLNGPRRLDLIKQIRQACQHDGFFQVKNHEIPETIINNMLSIARAFFKLPESERLKSYSDDPSKSTRLSTSFNVNTEKVANWRDYLRLYYYPLQDYMHEWPSNPPSFREVVTEYYTSVRGLVPKLLEAISESLGVQRDNVDKALGKHGQHMALNYCPPCPQPDLTYELPRHTDPNLITVLLQDDVPGLQLLRNGKWLPGSPIPNTFIVNIGDQMQVLSNDLYKSVLHRALVSCDKERISIPTFYCPSLDAVIAPTKDLIDERHLAFYKNFTYAEYYQKF

SEQ ID NO: 71 - protein, 304 aa, Citrus clementina
MAAAATTHIKLLLSDLASTLQNVPSDYIRPISDRPNLTDQAHISDGSIPLIDLQGLYGPRRSDIIKQIGQACQHGGFFQVKNHGISEAMINNMLSIARTFFKLPERERLKNYSDDPLKPTRLSTSFNVKTEKASNRRDFLRLHCYPLQDYVHDWPLNPPSFREDVGDYCTSVRGLVLRLIEAISESLRLPSDYIDKEALGKHGQHMALNYYPPCPPPELTYGLPGHTDPNLITIHRAVVSRDKERTLVPIIAENLHLIADVDNEGLIDQDHPAVYRDFTYAEYYEKFWNRGLAAECRLDMFKAS

SEQ ID NO: 72 - protein, 192 aa, Citrus clementina
MAAAATTHIKLLLSDLASTLQNVPSDYIRPISDRPNLTDQAHISDGSIPLIDLQGLYGPRRSDIIKQIGQACQHGGFFQVKNHGISEAMINNMLSIARTFFKLPERERLKNYSDDPLKPTRLSTSFNVKTEKASNRRDFLRLHCYPLQDYVHDWPLNPPSFREDVGDYCTSARGFVTGKMWVTTVQVLEGWC

SEQ ID NO: 73 - protein, 226 aa, Citrus unshiu
MPSMHQHECFFQVKNHGISEAMINNMLSIARTFFNLPERERLKIYSDDPLKPTRLSTSFNVKTEKASNRRDFLRLYCYPLQDYVHDWPLNPPSFREDVGDYCTSVRGLVLRLIEAISESLRLPSDYIDKEALGKHGQHMALNYYPPCPPPELTYGLPGHTDPNLITIHRAVVSRDKERTLVPIIAENLHLIADVDNEGAGNMIYRNTFAVSEDLQSRDIILKKNSY

SEQ ID NO: 74 - protein, 164 aa, Citrus unshiu
MSAVATTATKLLLSDLAPTLKNVPSDYIRPISDRPNLTDQAHISDGSIPLIDLQGLYGPRRSDIIKQIGQACQHCGFFQVKNHGISEAMINNMLSIARTFFKLPESERLKIYSDDPSKPTRLSTSFNVKTEKVSNWRDFLRLHCYPLQDYVHDWPLNPPSFRYI

SEQ ID NO: 75 - protein, 196 aa, Citrus unshiu
MAAAATTTTKLLLSDRASTLKNVPSDYIRPISDRPNLTDQAHISEGSIPLIDLQGFYGLRRSDITKQIGQACQHGGFFQDDVPGLQVLRDGNWVPVNPIPSTFIVNIGDQMQVLSNDRYKSVLHRAVVSRDKERISIPTFYCPSPDAVICPAKGLVDHDHPAVYRDFTYAEYYEKFWNRGLATECCLDMFKASSTV

SEQ ID NO: 76 - protein, 339 aa, Citrus clementina
MAAATTKLLLSDLASTVKSVPSNYIRPISDRPNLTEVQISDGSIPLIDLQVLDGPRRLDIIKQIGQACQHDGFFQVKNHGIPETIINNMLSIARAFFKLPESERLKSYSDDPSKSTRLSTSFNVNTEKVSNRRDYLRLHCYPLQDYIHEWPSNPPSFREVVAEYCTSARGAWGLQRDYIDKALGKHGQHMALNYYPPCPQPDLTYGLPGHTDPNLITVLLQDDVPGLQVLRKGKWLPFSLDYDFRIGYRPHTHIHNFESLAICLIPNTFIVNIGDQMQVLSNDRYKSVLHRALVNCDKEHISILTFYCSSPDAVIAHAKDLIDERHPTVYKNFTYSEYY

SEQ ID NO: 77 - protein, 233 aa, Citrus sinensis
MAAATTKLLLSDLASTVESVTSNYIRPISDRPNLTEVQISDGSIPLIDLQVLDGPRRLDLIKQIGQACHHDGFFQVKNHGIPETIINNTLSIAGAFFKLPESERLKSYSDDPSKSKRLSTSFNVNTKKVSNWRDYLRLHCYPLQDCMHEWPSNPPSFEVVAEYCTSVRGLVLKLLEAISESMGLQRDYIDKALGKHGQQMALNYCPPCPQPDLTYGLPGHTDPNLITVLLQDD

SEQ ID NO: 78 - protein, 354 aa, Citrus sinensis
MSAVATTATKLLLSDLAPTLKNVPSDYIRPISDRPNLTDQAHISDGSIPLIDLQGLYGPRRSDIIKQIGQACQHCGFFQVKNHGISEAMINNMLSIARTFFKLPESERLKIYSDDPSKPTRLSTSFNVKTEKVSNWRDFLRLHCYPLQDYVHDWPLNPPSFREDVGDYCTSVRGLVLRLIEAISESLGLPSDYIDKEALGKHGQHMALNYYPPCPQPELTYGLPGHTDPNLITILLQDDVPGLQVLRDGNWVPVNPIPSTFIVNIGDQMQVLSNDRYKSVLHRAVVSRDKERISIPTFYCPSSDAVIGPAKGLVDQDLPAVYRDFTYAEYYKKFWNRGLATECCLDMFKASSTV

SEQ ID NO: 79 - protein, 354 aa, Citrus clementina
MSAAATTATKLLLSDLAPTLTNVPSDYIRPISDRPSLTDQTHISDGSIPLIDLQGLNGPRRSDIIKQIGQACQHCGFFQVKNHGISEAMINNMLSIARTFFKLPESERLKIYSDDPSKPTRLSTSFNVKTEKVSNWRDFLRLHCYPLQDYVHDWPLNPPSFREDVGDYCTSVRGLVLRLIQAISESLGLPSDYIDKEALGKHGQHMALNYYPPCPQPELTYGLPGHTDPNLITLLLQDDVPGLQVLRDGNWVPVNPIPSTFIVNIGDQMQVLSNDRYKSVLHRAVVSRDKERISIPTFYCSSPDAVIGPAKGLVDQDHPAVYRDFTYAEYYKKFWNRGLATECCLEMFKASSTV

SEQ ID NO: 80 - protein, 244 aa, Citrus sinensis
MAAATTKLLLSDLASTVKSVPSNYIRPISDRPNLTEVQISDGSIPLVDLQVLNGPSRLDIIKQIGQACQHDGFFQVKNHGIPETIINNMLTIARAFFKLPEKSERLKSYSDDPSKSKRLSTSFNVNTKKVSNWRDYLRLHCYPLQDCMHEWPSNPPSFEVVAEYCTSVRGLVLKLLEAISESMGLQRDYIDKALGKHGQQMALNYCPPCPQPDLTYGLPGHTDPNLITVLLQDDVMKQKQTLCP

SEQ ID NO: 81 - protein, 304 aa, Citrus cavaleriei
MSAVATTATKLLLSDLAPTLKNVPSDYIRPISDRPNLTDQAHISDGSIPLIDLQGLYGPRRSDIIKQIGQACQHCGFFQVKNHGILEAMINNMLSIARTFFNLPERERLKIYSDDPLKPTRLSTSFNVKTEKASNRRDFLRLHCYPLQDYVHDWPLNPPSFREDVGDYCTSVRGLVLRLIEAISESLRLPSDYIDKEALGKHGQHMTLNYYPPCPPPELTYGLPGHTDPNLITIHQAVVSRDKERTLVPIIAENLHLIADVDNEGLIDQDHPAVYRDFTYAEYYEKSWNRGLAAQCCLDMFKAS

SEQ ID NO: 82 - protein, 496 aa, Citrus trifoliata
MDSTSRSSVIIIGAGISGISAGKILAENGIEDILILEASDRIGGRVRNEKFGGVSVELGAGWIAGVGGKESNPVWELASKSGLRTCFSDYTNARYNIYDRSGKIIPSGVAADSYKKAVESAIANLKNLEATNSNIGEVIKAAMELPSSPKTPLELAIDFILHDFEMAEVEPISTYVDFGEREFLVADERGYAHLLYKMAEEFLSTSDGKILDNRLKLNKVVRELQHSRNGVTVKTEDGCVYEANYVILSASIGVLQSDLISFKPPLPKWKTEAIEKCDVMVYTKIFLKFPCKFWPCSPEKEFFIYAHERRGYYTFWQHMENAYPGSNILVVTLTNGESKRVEAQPDEETLKEAMEVLRDMFGPDIPNATDILVPRWWNNRFQRGSYSDYPIISDNQLVNNIRAPVGGIFFTGEHTSERFNGYVHGGYLAGIDTGKAVVEKIRKDNERNNSETQNFLLEPLLALTLTQTEAMPSLHKCDIPKQLYLSGKLGIPEAIL

SEQ ID NO: 83 - protein, 496 aa, Citrus clementina
MDSTSRSSVIIIGAGVSGISAGKILAENGIEDILILEASDRIGGRVRNEKFGGVSVELGAGWIAGVGGKESNPVWELASKSGLRTCFSDYTNARYNIYDRSGKIIPSGVAADSYKKAVESAIANLKNLEATNSNIGEVIKAATELPSSPKTPLELAIDFILHDFEMAEVEPISTYVDFGEREFLVADERGYAHLLYKMAEEFLSTSDGKILDNRLKLNKVVRELQHSRNGVTVKTEDGCVYEANYVILSASIGVLQSDLISFKPPLPKWKTEAIEKCDVMVYTKIFLKFPCKFWPCSPEKEFFIYAHERRGYYTFWQHMENAYPGSNILVVTLTNGESKRVEAQPDEETLKEAMEVLQDMFGPDIPNATDILVPRWWNNRFQRGSYSNYPIISDNQLVNSIRAPVGGIFFTGEHTSERFNGYVHGGYLAGIDTGKAVVEKIRKDNERNNSETQNFLLEPLLALTLTQTEAMSSLHKCDIPKQLYLSGKLGIPEAIL

SEQ ID NO: 84 - protein, 497 aa, Citrus sinensis
MDSTSRSSVIIIGAGVSGISAGKILAENGIEDILILEASDRIGGRVRNEKFGGVSVELGAGWIAGVGGKESNPVWELASKSGLRTCFSDYTNARYNIYDRSGKIIPSGVAADSYKKAVESAIANLKNLEATNSNIGEVIKAATELPSSPKTPLELAIDFILHDFEMAEVEPISTYVDFGEREFLVADERGYAHLLYKMAEEFLSTSDGKILDNRLKLNKVVRELQHSRNGVTVKTEDGCVYEANYVILSASIGVLQSDLISFKPPLPQKWKTEAIEKCDVMVYTKIFLKFPCKFWPCSPEKEFFIYAHERRGYYTFWQHMENAYPGSNILVVTLTNGESKRVEAQPDEETLKEAMEVLQDMFGPDIPNATDILVPRWWNNRFQRGSYSNYPIISDNQLVNSIRAPVGGIFFTGEHTSERFNGYVHGGYLAGIDTGKAVVEKIRKDNERNNSETQNFLLEPLLALTLTQTEAMSSLHKCDIPKQLYLSGKLGIPEAIL

SEQ ID NO: 85 - protein, 496 aa, Citrus trifoliata
MDSTSRSSVIIIGAGISGISAGKILAENGIEDILILEASDRIGGRVRNEKFGGVSVELGAGWIAGVGGKESNPVWELASKSGLRTCFSDYTNARYNIYDRSGKIIPSGVAADSYKKAVESAIANLKNLEATNSNIGEVIKAAMELPSSPKTPLELAIDFILHDFEMAEVEPISTYVDFGEREFLVADERGYAHLLYKMAEEFLSTSDGKILDNRLKLNKVVRELQHSRNGVTVKTEDGCVYEANYVILSASIGVLQSDLISFKPPLPKWKTEAIEKCDVMVYTKIFLKFPCKFWPCSPEKEFFIYAHERRGYYTFWQHMENAYPGSNILVVTLTNGESKRVEAQPDEETLKEAMEALRDMFGPDIPNATDILVPRWWNNRFQRGSYSDYPIISDNQLVNNIRAPVGGIFFTGEHTSERFNGYVHGGYLAGIDTGKAVVEKIRKDNERNNSETQNFLLEPLLALTLTQTEAMPSLHKCDIPKQLYLSGKLGIPEAIL

SEQ ID NO: 86 - protein, 497 aa, Solanum lycopersicum
METPRRSSVIIVGAGISGLTAAKVLSENGVDDVVILEAADKIGGRIRKEEFGGVAAELGAGWIAGVGGKQSNPVWELALQSNLRTCFSDYSNARYNIYDHSGKIFPSGIAADSYKKAVDSAIQKLRSQEGNHNEDTDDAAETPSTPKTPIELAIDFILHDFEMAEVEPISTYVDFGEREFLVADERGYEHLLYKMAENFLFTCEGKIMDSRLKLNTVVREVQHSRNGVLVTTEDGSLYEANYVILSVSIGVLQSDLISFSPSLPRWKMEAVRNLDVMVYTKIFLKFPNKFWPCEPEKEFFIYAHERRGYYTFWQHMENAYPGSNMLVVTLTNGESKRVEAQSDQDTLREAMEVLRNMFGPDIPDATDILVPRWWNNRFQRGSYSNYPIYANHQLVHDIKEPVGRIFFTGEHTSEKFSGYVHGGYLSGIDTSNALLEKMRRDDGRKNESQAFLLEPLLALTGSLTLTQAETVSSLHKCDIPRQLFLSNSKLGLPEAIL

SEQ ID NO: 87 - protein, 495 aa, Solanum tuberosum
MEIPRRSSVIIIGAGISGLTAAKVLSENGVDDVVILEAADKIGGRIRKEEFGGVAAELGAGWIAGVGGKQSNPVWELALQANLRTCFSDYSNARYNIYDHSGKIFPSGIAADSYKKAVDSAIQKLRSQEGNHNENTEDAAETPSTPKTPIELAIDFFLHDFEMAEVEPISTYVDFGEREFLVADERGYEHLLYKMAENFLFTSEGKIMDSRLKLNTVVREVQHSRNGVLVTTEDGPLYEANYVILSVSIGVLQSDLISFSPPLPRWKMEAVRNLDVMIYTKIFLKFPYKFWPCEPEKEFFIYAHERRGYYTFWQHMENAYPGSNMLVVTLTNGESKRVEAQSDQDTLREAMEVLRNMFGPDIPNATDILVPRWWNNRFQRGSYSNYPIYANHQLVHDIKEPVGRIFFTGEHTSEKFSGYVHGGYLSGIDSSNALLEKMRRDDGWKNESQAFLLEPLLALTGSLTLTQAETVSSLHKCDIPRQLFLSNSKLAEAIL

SEQ ID NO: 88 - protein, 863 aa, Citrus trifoliata
MVSRSYSNLLDLASGDFPNFSREKKRLPRVATVAGVLSEIDDENSNSVGSDAPSSVSQERMIIVGNQLPLRAHRSSDGSGGWTFSWDEDSLLLQLKDGLGEDVEVIYVGCIKEQIDLSEQDEVSQTLLETFKCVPAFIPPELFSKFYHGFCKQHLWPLFHYMLPLSPDLGGRFDRSLWQAYVSVNKIFADKVMEVISPDDDFVWVHDYHLMVLPTFLRKRFNRVKLGFFLHSPFPSSEIYRTLPIRDELLRALLNADLIGFHTFDYARHFLSCCSRMLGVSYQSKRGYIGLEYFGRTVSIKILPVGIHIGQLQSVLNLPETEAKVAELQDQFKGQIVMLGVDDMDIFKGISLKLLAMEQLLSQNPSKRGKIVLVQIANPARGRGRDVQEVQSETHATVRRINKIFGRPGYQPVVLIDTPLQFYERIAYYVIAECCLVTAVRDGMNLIPYEYIICRQGNEKLDMTLGLDPSTAKSSMLVVSEFVGCSPSLSGAIRVNPWNIDAVAEAMDSALGVSDAEKQMRHEKHYRYVSTHDVAYWARSFLQDLERACRDHMRRRCWGIGFGLGFRVVALDPNFRKLSIDHIVSAYKRTKNRAILLDYDGTMMVPGSISTSPNAEAVAILDNLCRDPKNVVFLVSGKDRDTLAEWFSSCEGLGIAAEHGYFVRPNYGVDWETCVSVPDFSWKQIAEPVMKLYTETTDGSTIETKESALVWNFQYADPDFGSCQAKELLDHLESVLANEPVSVKSGPNIVEVKPQGVNKGLVAQHQLETMHQKGMLPDFVLCIGDDRSDEDMFEVIKSAAAGPSLSPVAEVFACTVGQKPSKAKYYLDDTAEILRMLLGLAEASAHNAYKASQGSQRVVINKE

SEQ ID NO: 89 - protein, 854 aa, Citrus trifoliata
MVSKSYSNLLELASGEAPSFGRMSRRIPRIMTVAGIISDLDDDPADSVCSDPSSSSVQRDRIIIVANQLPIRAQRKSDNSKGWIFSWDENSLLLQLKDGLGDDDIEVIYVGCLKEEIHVNEQDEVSQILLETFKCVPTFLPPDLFSRYYHGFCKQQLWPLFHYMLPLSPDLGGRFNRSLWQAYVSVNKIFADRIMEVINPEDDFVWVHDYHLMVLPTFLRKRFNRVKLGFFLHSPFPSSEIYKTLPIREEILRALLNSDLIGFHTFDYARHFLSCCSRMLGLTYESKRGYIGLEYYGRTVSIKILPVGIHMGQLQSVLSLPETEAKVSELVKQFHDQGKVMLLGVDDMDIFKGISLKLLAMEQLLIQHPEWQGKVVLVQIANPARGRGKDVKEVQAETYSTVERINQTFGKPGYDPVVLIDEPLKFYERIAYYVVAECCLVTAVRDGMNLIPYEYIISRQGNEKLDKVVGSEPSSPKKSMLVVSEFIGCSPSLSGAIRVNPWNIDAVADAMDGALEMADQEKQLRHEKHYRYVSTHDVGYWARSFLQDLERTCREHVRQRCWGIGFGLSFRVVALDPNFKKLSMEHIVSAYKRTTTRAILLDYDGTLMPQASIDKSPNSKTIDILNSLCRDKNNMVFLVSAKSRKTLAEWFSPCENLGIAAEHGYFFRLRRDEEWETCIPVADCGWKQIAEPVMKLYTETTDGSTIEDKETALVWSYEDADPDFGSCQAKELLDHLESVLANEPVTVKSGQNLVEVKPQGVNKGLVAKRLLSTMQEWEMLPDFVLCVGDDRSDEDMFEVIISSTAGPSIAPRAEVFACTVVQKPSKAKYYLDDTVEIVRLMQGLACVADQMVSV

SEQ ID NO: 90 - protein, 855 aa, Citrus trifoliata
MSKSYTNLLDLASGNFPAMGPSREKKRLPRVMTVPGVISELDDDQANSVSSDVPSSVAQDRVIIVANQLPVKAKRRPDNKGWSFSWDEDSLLLQLKDGLPEDMEVIYVGSLKVDVDLSEQDDVSQLLLDRFKCVPAFLPPDILTKFYHGFCKQHLWPLFHYMLPFSATHGGRFDRSLWEAYVSANKIFSQRVIEVINPEDDYVWIHDYHLMVLPTFLRRRFTRLRMGFFLHSPFPSSEIYRTLPVREEILKALLNADLIGFHTFDYARHFLSCCSRMLGLEYQSKRGYIGLEYYGRTVGIKIMPVGIHMGQIESVLRLADKDWRVQELKQQFEGKTVLLGVDDMDIFKGVDLKLLAMEHLLKQHPKWQGRAVLVQIANPARGRGKDLEEIQAEIHATCRRINETFGRPGYEPVVFIDKPVSLSERAAYYTIAECVVVTAVRDGMNLTPYEYIVCRQGVSGSESSSESSAPKKSMLVVSEFIGCSPSLSGAIRVNPWNIEATAEAMHEAIQMNEAEKQLRHEKHYRYVSTHDVAYWARSFFQDMERTCKDHFKRRCWGIGLSFGFRVVALDPNFRKLSIDAIVSAYLRSKSRAILFDYDGTVMPQTSINKAPSQAVISIINTLCNDARNAVFVVSGRGRDSLGKWFSPCKKLGIAAEHGYFMRWSADEEWQNCGQSVDFGWIQIAEPVMKLYTESTDGSYIEIKESALVWHHRDADPGFGSSQAKELLDHLESVLANEPAAVKSGQFIVEVKPQGVSKGVVAEKIFTTMAESGRHADFVLCIGDDRSDEDMFEIIGNATSSGVLSSNASVFACTVGQKPSKAKYYLDDAAEVVTMLEALAEASAPPSFEVGASDSP

SEQ ID NO: 91 - protein, 863 aa, Citrus clementina
MVSRSYSNLLDLASGDFPNFSREKKRLPRVATVAGVLSEIDDENSNSVGSDAPSSVSQERMIIVGNQLPLRAHRSSDGSGGWTFSWDEDSLLLQLKDGLGEDVEVIYVGCIKEQIDLSEQDEVSQTLLETFKCVPAFIPPELFSKFYHGFCKQHLWPLFHYMLPLSPDLGGRFDRSLWQAYVSVNKIFADKVMEVISPDDDFVWVHDYHLMVLPTFLRKRFNRVKLGFFLHSPFPSSEIYRTLPIRDELLRALLNADLIGFHTFDYARHFLSCCSRMLGVSYQSKRGYIGLEYFGRTVSIKILPVGIHIGQLQSVLNLPETEAKVAELQDQFKGQIVMLGVDDMDIFKGISLKLLAMEQLLSQNPSKRGKIVLVQIANPARGRGRDVQEVQSETHATVRRINKIFGRPGYQPVVLIDTPLQFYERIAYYVIAECCLVTAVRDGMNLIPYEYIICRQGNEKLDMTLGLDPSTAKSSMLVVSEFVGCSPSLSGAIRVNPWNIDAVAEAMDSALGVSDAEKQMRHEKHYRYVSTHDVAYWARSFLQDLERACRDHMRRRCWGIGFGLGFRVVALDPNFRKLSIDHIVSAYKRTKNRAILLDYDGTIMVPGSISTSPNAEAVAILDNLCRDPKNVVFLVSGKDRDTLAEWFSSCEGLGIAAEHGYFVRPNYGVDWETCVSVPDFSWKQIAEPVMKLYTETTDGSTIETKESALVWNFQYADPDFGSCQAKELLDHLESVLANEPVSVKSGPNIVEVKPQGVNKGLVAQHQLETMHQKGMLPDFVLCIGDDRSDEDMFEVIKSAAAGPSLSPVAEVFACTVGQKPSKAKYYLDDTAEILRMLLGLAEASAQDACKASLGSQRVVINKE

SEQ ID NO: 92 - protein, 885 aa, Citrus unshiu
MVLIPTCHLQCCLAEVGVRRASKVLLDSKRSSEYDVSLFEDFCREKKRLPRVATVAGVLSEIDDENSNSVGSDAPSSVSQERMIIVGNQLPLRAHRSSDGSGGWTFSWDEDSLLLQLKDGLGEDVEVIYVGCIKEQIDLSEQDEVSQTLLETFKCVPAFIPPELFSKFYHGFCKQHLWPLFHYMLPLSPDLGGRFDRSLWQAYVSVNKIFADKVMEVISPDDDFVWVHDYHLMVLPTFLRKRFNRVKLGFFLHSPFPSSEIYRTLPIRDELLRALLNADLIGFHTFDYARHFLSCCSRMLGVSYQSKRGYIGLEYFGRTVSIKILPVGIHIGQLQSVLNLPETEAKVAELQDQFKGQIVMLGVDDMDIFKGISLKLLAMEQLLSQNPSKRGKIVLVQIANPARGRGRDVQEVQSETHATVRRINKIFGRPGYQPVVLIDTPLQFYERIAYYVIAECCLVTAVRDGMNLIPYEYIICRQGNEKLDMTLGLDPSTAKSSMLVVSEFVGCSPSLSGAIRVNPWNIDAVAEAMDSALGVSDAEKQMRHEKHYRYVSTHDVAYWARSFLQDLERACRDHMRRRCWGIGFGLGFRVVALDPNFRKLSIDHIVSAYKRTKNRAILLDYDGTIMVPGSISTSPNAEAVAILDNLCRDPKNVVFLVSGKDRDTLAEWFSSCEGLGIAAEHGYFVRPNYGVDWETCVSVPDFSWKQIAEPVMKLYTETTDGSTIETKESALVWNFQYADPDFGSCQAKELLDHLESVLANEPVSVKSGPNIVEVKPQGVNKGLVAQHQLETMHQKGMLPDFVLCIGDDRSDEDMFEVIKSAAAGPSLSPVAEVFACTVGQKPSKAKYYLDDTAEILRMLLGLAEASAHDACKASQGSQRVVINKE

SEQ ID NO: 93 - protein, 803 aa, Citrus sinensis
MIIVGNQLPLRAHRSSDGSGGWTFSWDEDSLLLQLKDGLGEDVEVIYVGCIKEQIDLSEQDEVSQTLLETFKCVPAFIPPELFSKFYHGFCKQHLWPLFHYMLPLSPDLGGRFDRSLWQAYVSVNKIFADKVMEVISPDDDFVWVHDYHLMVLPTFLRKRFNRVKLGFFLHSPFPSSEIYRTLPIRDELLRALLNADLIGFHTFDYARHFLSCCSRMLGVSYQSKRGYIGLEYFGRTVSIKILPVGIHIGQLQSVLNLPETEAKVAELQDQFKGQIVMLGVDDMDIFKGISLKLLAMEQLLSQNPSKRGKIVLVQIANPARGRGRDVQEVQSETHATVRRINKIFGRPGYQPVVLIDTPLQFYERIAYYVIAECCLVTAVRDGMNLIPYEYIICRQGNEKLDMTLGLDPSTAKSSMLVVSEFVGCSPSLSGAIRVNPWNIDAVAEAMDSALGVSDAEKQMRHEKHYRYVSTHDVAYWARSFLQDLERACRDHMRRRCWGIGFGLGFRVVALDPNFRKLSIDHIVSAYKRTKNRAILLDYDGTIMVPGSISTSPNAEAVAILDNLCRDPKNVVFLVSGKDRDTLAEWFSSCEGLGIAAEHGYFVRPNYGVDWETCVSVPDFSWKQIAEPVMKLYTETTDGSTIETKESALVWNFQYADPDFGSCQAKELLDHLESVLANEPVSVKSGPNIVEVKPQGVNKGLVAQHQLETMHQKGMLPDFVLCIGDDRSDEDMFEVIKSAAAGPSLSPVAEVFACTVGQKPSKAKYYLDDTAEILRMLLGLAEASAQDACKASLGSQRVVINKE

SEQ ID NO: 94 - protein, 854 aa, Citrus clementina
MVSKSYSNLLELASGEAPSFGRMRRRIPRIMTVAGIISDLDDDPADSVCSDPSSSSVQRDRIIIVANQLPIRAQRKSDNSKGWIFSWDENSLLLQLKDGLGDDDIEVIYVGCLKEEIHVNEQDEVSQILLDTFKCVPTFLPPDLFSRYYHGFCKQQLWPLFHYMLPLSPDLGGRFNRSLWQAYVSVNKIFADRIMEVINPEDDFVWVHDYHLMVLPTFLRKRFNRVKLGFFLHSPFPSSEIYKTLPIREEILRALLNSDLIGFHTFDYARHFLSCCSRMLGLTYESKRGYIGLEYYGRTVSIKILPVGIHMGQLQSVLSLPGTEAKVSELIKQFHDQGKVMLLGVDDMDIFKGISLKLLAMEQLLIQHPEWQGKVVLVQIANPARGRGKDVKEVQAETYSTVERINQTFGKPGYDPVVLIDEPLKFYERIAYYVVAECCLVTAVRDGMNLIPYEYIISRQGNEKLDKVLGSEPSSPKKSMLVVSEFIGCSPSLSGAIRVNPWNIDAVSDAMDSALEMADQEKQLRHEKHYRYVSTHDVGYWARSFLQDLERTCREHVRQRCWGIGFGLSFRVVALDPNFKKLSMEHIVSAYKRTTTRAILLDYDGTLMPQASIDKSPNSKTIDILNSLCRDKNNMVFLVSAKSRKTLAEWFSPCENLGIAAEHGYFFRLRRDEEWETCIPVADCGWKQIAEPVMKLYTETTDGSTIEDKETALVWSYEDADPDFGSCQAKELLDHLESVLANEPVTVKSGQNLVEVKPQGVNKGLVAKRLLSTMQEREMLPDFVLCVGDDRSDEDMFEVIISSMAGPSIAPRAEVFACTVGRKPSKAKYYLDDTVEIVRLMQGLACVADQMVPV

SEQ ID NO: 95 - protein, 831 aa, Citrus sinensis
MVSKSYSNLLELASGEAPSFGRMRRRIPRIMTVAGIISDLDDDPADSVCSDPSSSSVQRDRIIIVANQLPIRAQRKSDNSKGWIFSWDENSLLLQLKDGLGDDDIEVIYVGCLKEEIHVNEQDEVSQILLDTFKCVPTFLPPDLFSRYYHGFCKQQLWPLFHYMLPLSPDLGGRFNRSLWQAYVSVNKIFADRIMEVINPEDDFVWVHDYHLMVLPTFLRKRFNRVKLGFFLHSPFPSSEIYKTLPIREEILRALLNSDLIGFHTFDYARHFLSCCSRMLGLTYESKRGYIGLEYYGRTVSIKILPVGIHMGQLQSVLSLPGTEAKVSELIKQFHDQGKVMLLGVDDMDIFKGISLKLLAMEQLLIQHPEWQGKVVLVQIANPARGRGKDVKEVQAETYSTVERINQTFGKPGYDPVVLIDEPLKFYERIAYYVVAECCLVTAVRDGSEPSSPKKSMLVVSEFIGCSPSLSGAIRVNPWNIDAVSDAMDSALEMADQEKQLRHEKHYRYVSTHDVGYWARSFLQDLERTCREHVRQRCWGIGFGLSFRVVALDPNFKKLSMEHIVSAYKRTTTRAILLDYDGTLMPQASIDKSPNSKTIDILNSLCRDKNNMVFLVSAKSRKTLAEWFSPCENLGIAAEHGYFFRLRRDEEWETCIPVADCGWKQIAEPVMKLYTETTDGSTIEDKETALVWSYEDADPDFGSCQAKELLDHLESVLANEPVTVKSGQNLVEVKPQGVNKGLVAKRLLSTMQEREMLPDFVLCVGDDRSDEDMFEVIISSMAGPSIAPRAEVFACTVGRKPSKAKYYLDDTVEIVRLMQGLACVADQMVPV

SEQ ID NO: 96 - protein, 856 aa, Citrus clementina
MMSKSYTNLLDLASGNFPAMGPSREKKRLPRVMTVPGVISELDDDQANSVSSDVPSSVAQDRVIIVANQLPVKAKRRPDNKGWSFSWDEDSLLLQLKDGLPEDMEVIYVGSLKVDVDLSEQDDVSQLLLDRFKCVPAFLPPDILTKFYHGFCKQHLWPLFHYMLPFSATHGGRFDRSLWEAYVSANKIFSQRVIEVINPEDDYVWIHDYHLMVLPTFLRRRFTRLRMGFFLHSPFPSSEIYRTLPVREEILKALLNADLIGFHTFDYARHFLSCCSRMLGLEYQSKRGYIGLEYYGRTVGIKIMPVGIHMGQIESVLRLADKDWRVQELKQQFEGKTVLLGVDDMDIFKGVDLKLLAMEHLLKQHPKWQGRAVLVQIANPARGRGKDLEEIQAEIHATCKRINETFGRPGYEPVVFIDKPVTLSERAAYYTIAECVVVTAVRDGMNLTPYEYIVCRQGVSGSESSSESSAPKKSMLVVSEFIGCSPSLSGAIRVNPWNIEATAEAMHEAIQMNEAEKQLRHEKHYRYVSTHDVAYWARSFFQDMERTCKDHFKRRCWGIGLSFGFRVVALDPNFRKLSIDAIVSAYLRSKSRAILFDYDGTVMPQTSINKAPSQAVISIINTLCNDARNTVFVVSGRGRDSLGKWFSPCKKLGIAAEHGYFMRWSADEEWQNCGQSVDFGWIQIAEPVMKLYTESTDGSYIEIKESALVWHHRDADPGFGSSQAKELLDHLESVLANEPAAVKSGQFIVEVKPQGVSKGVVAEKIFTTMAESGRHADFVLCIGDDRSDEDMFEIIGNATSSGVLSSNASVFACTVGQKPSKAKYYLDDAAEVVTMLEALAEASAPPSFEVGASDSP

SEQ ID NO: 97 - protein, 856 aa, Citrus sinensis
MMSKSYTNLLDLASGNFPAMGPSREKKRLPRVMTVPGVISELDDDQANSVSSDVPSSVAQDRVIIVANQLPVKAKRRPDNKGWSFSWDEDSLLLQLKDGLPEDMEVIYVGSLKVDVDLSEQDDVSQLLLDRFKCVPAFLPPDILTKFYHGFCKQHLWPLFHYMLPFSATHGGRFDRSLWEAYVSANKIFSQRVIEVINPEDDYVWIHDYHLMVLPTFLRRRFTRLRMGFFLHSPFPSSEIYRTLPVREEILKALLNADLIGFHTFDYARHFLSCCSRMLGLEYQSKRGYIGLEYYGRTVGIKIMPVGIHMGQIESVLRLADKDWRVQELKQQFEGKTVLLGVDDMDIFKGVDLKLLAMEHLLKQHPKWQGRAVLVQIANPARGRGKDLEEIQAEIHATCKRINETFGRPGYEPVVFIDKPVTLSERAAYYTIAECVVVTAVRDGMNLTPYEYIVCRQGVSGSESSSESSAPKKSMLVVSEFIGCSPSLSGAIRVNPWNIEATAEAMHEAIQMNEAEKQLRHEKHYRYVSTHDVAYWARSFFQDMERTCKDHFKRRCWGIGLSFGFRVVALDPNFRKLSIDAIVSAYLRSKSRAILFDYDGTVMPQTSINKAPSQAVISIINTLCNDARNTVFVVSGRGRDCLGKWFSPCKKLGIAAEHGYFMRWSADEEWQNCGQSVDFGWIQIAEPVMKLYTESTDGSYIEIKESALVWHHRDADPGFGSSQAKELLDHLESVLANEPAAVKSGQFIVEVKPQGVSKGVVAEKIFTTMAESGRHADFVLCIGDDRSDEDMFEIIGNATSSGVLSSNASVFACTVGQKPSKAKYYLDDAAEVVTMLEALAEASAPPSFEVGASDSP

SEQ ID NO: 98 - protein, 761 aa, Citrus sinensis
MMSKSYTNLLDLASGNFPAMGPSREKKRLPRVMTVPGVISELDDDQANSVSSDVPSSVAQDRVIIVANQLPVKAKRRPDNKGWSFSWDEDSLLLQLKDGLPEDMEVIYVGSLKVDVDLSEQDDVSQLLLDRFKCVPAFLPPDILTKFYHGFCKQHLWPLFHYMLPFSATHGGRFDRSLWEAYVSANKIFSQRVIEVINPEDDYVWIHDYHLMVLPTFLRRRFTRLRMGFFLHSPFPSSEIYRTLPVREEILKALLNADLIGFHTFDYARHFLSCCSRMLGLEYQSKRGYIGLEYYGRTVGIKIMPVGIHMGQIESVLRLADKDWRVQELKQQFEGKTVLLGVDDMDIFKGVDLKLLAMEHLLKQHPKWQGRAVLVQIANPARGRGKDLEEIQAEIHATCKRINETFGRPGYEPVVFIDKPVTLSERAAYYTIAECVVVTAVRDGMNLTPYEYIVCRQGVSGSESSSESSAPKKSMLVVSEFIGCSPSLSGAIRVNPWNIEATAEAMHEAIQMNEAEKQLRHEKHYRYVSTHDVAYWARSFFQDMERTCKDHFKRRCWGIGLSFGFRVVALDPNFRKLSIDAIVSAYLRSKSRAILFDYDGTVMPQTSINKAPSQAVISIINTLCNDARNTVFVVSGRGRDCLGKWFSPCKKLGIAAEHGYFMRWSADEEWQNCGQSVDFGWIQIAEPVMKLYTESTDGSYIEIKESALVWHHRDADPGFGSSQAKELLDHLESVLANEPAAVKSGQFIVEVKPQVYIQLRI

SEQ ID NO: 99 - protein, 1039 aa, Citrus trifoliata
MENYLKKNFDVDPKRPSEEALMRWRSAVRVVKNPRRRFRMVADLAKRAEAERKRKKLQEKLRVALYVQKAALHFIDAGSRPIEYKLSQETLLAGYGIEPDELESIVRSHNSKAVESHGGVEGLAREVSVSLPDGVASEEVSNRQNVYGFNRYAEKPARSFWMFVWEALHDLTLIILMICAAVSIGVGIPTEGWPDGMYDGLGIVLSILLVVIVTAVSDYKQSLQFKALDKEKKNLIVQVTRDGYRKKLSIYDLVVGDIVHLSIGDQVPADGILISGYNLTIDESSLSGETEPVHINRDRPFLLSGTKVQDGSGKMLVTSVGMRTEWGRLMVTLSEGGEDETPLQVKLNGVATVIGKIGLVFAVLTFLVLTLRFLVEKAQHHQIKNWSSIDAMKLLNYFAIAVTIVVVAVPEGLPLAVTLSLAFAMKKLMNDKALVRHLSACETMGSASCICTDKTGTLTTNHMVVTKLWICNEAKTIKRGDNEKLLKPSVSDAVFNIFLQSIFQNTGSEVVKDKDGRTNILGTPTERAILEFGLILGGDSKFHREESAIVKVEPFNSVKKRMSVLVSLPNNGGFRAFCKGASEIILNMCNKIINADRKAVPISEEQRKNLTNVINGFSSEALRTLCLAFQDIKGNHKAESIPENNYTLIAVVGIKDPVRPGVREAVETCLAAGITVRMVTGDNIHTAKAIAKECGILTDGGLAIEGTDFRSKNPQEMQELIPKLQVMARSSPTDKYILVTQLRNVFKEVVAVTGDGTNDAPALHEADIGLAMGIAGTEVAKENADVIIMDDNFTTIVTVARWGRSVYINIQKFVQFQLTVNIVALVINFVAACITGSAPLTAVQLLWVNMIMDTLGALALATEPPHEGLMQRPPIGRNVHFITVTMWRNIIGQSIYQIIVLGVLTFCGKKILKLSGPNATLILNTFIFNSFVFCQVFNEINSRDMEKINVFRGIFSSWVFIAVLVATVGFQVIIVELLGTFATTVPLNWKLWLASVVIGAISMPFGVLLKCIPAGTCTSAANSKHHDGYEPLPTGPDLA

SEQ ID NO: 100 - protein, 1036 aa, Citrus trifoliata
MDKFLNWKDFDVEHKNPSEEALRRWRSAVSIVKNRRRRFRMVADLVKRSEGEKKKLKIQEKIRVALYVQKAALTFIDAAGRPEYKLSEETRDAGFLIDPDDLAAIVRGRDIKGLKSNDGVEGVAQKLSVSLNEGVCKRDLPIRQKIYGVNRYTEKPPRSFLMFVWDALQDLTLIILIVCAVLSIGVGLATEGWPEGMYDGLGIILSILLVVMVTAISDYKQSLQFRDLDREKKKIFIQVTRDGQRQKVSIYDLVVGDIVHLSIGDQVAADGIFISGYSLLIDESSLSGESEPMYICEENPFLLAGTKVQDGSGKMLVTTVGMRTEWGKLMETLNEGGEDETPLQVKLNGVATIIGKIGLFFSVLTFLVLAGRFLGEKAIHNEFTVWSSADALTLIDYFAVAVTIIVVAVPEGLPLAVTLSLAFAMKKLMNDRALVRHLSACETMGSASCICTDKTGTLTTNHMVVDKIWICNTISKVEGNNKEDILQLEISERVLDITLQAIFQNTGSEVVKDKDGKNSILGTPTESAILEFGLRLGGDFEAQRREFKIVKVEPFNSVRKKMSVLIALPAGGMRAFCKGASEIVLSMCDKVVSDNGEPVPLSEEQFRNITDVINGFASEALRTLCLAFKDLNDSSNENNIPDSGYTLIAVVGIKDPVRPGVKEAVQTCLEAGITVRMVTGDNINTARAIAKECGILTSDGEAVEGPEFRNMSPADMKRIIPKLQVMARSLPLDKHTLVTQLRKTFGEVVAVTGDGTNDAPALHEADIGLSMGIAGTEVAKGNADVIILDDNFSTIVNVAKWGRAVYINIQKFVQFQLTVNVVALVINFVSACASGSAPLTAVQLLWVNMIMDTLGALALATEPPHEGLMKRPPVAKGESFITKVMWRNIIGQSIYQLIILVALNFDGKQILGLSGSDATAVLNTVIFNSFVFCQVFNEINSREMEKINVFKGMFDSWMFVGILVLTVAFQIIIIEFLGAFASTVPLSWHLWLLCILIGAVSMPIAVVIKCIPVKKSEPKLQHHDGYEEIPSGPESA

SEQ ID NO: 101 - protein, 1015 aa, Citrus trifoliata
MESYLQENFGVKPKHSSTEALEKWRNLCGVVKNPKRRFRFTANLPKRYEAAAMRKTNQEKLRIAVLVSKAAIQFLLGVTPSDYNVPEEVKAAGFQVCAEELGSITEGHDVKKLKFHGGVTGIAEKLSTSISDGLTSNTDLFNRRQEIYGLNQFAESTPRSFWVFVWEALQDMTLMILGACAFVSLIVGIVMEGWPHGAHDGLGIVASILLVVFVTATSDYRQSLQFKDLDKEKKKIFVQVTRNGFRQKLSIYDLLPGDIVHLGIGDQVPADGLFVSGFSVLIDESSLTGESEPVMVNEENPFMLSGTKLQDGSCKMMVTTVGMRTQWGKLMATLSEGGDDETPLQVKLNGVATIIGKGGLFFAVVTFAVLVQGLLSHKLGEGSIWSWSGDDALKLLEYFAVAVTIVVVAVPEGLPLAVTLSLAFAMKKMMNDKALVRHLAACETMGSASSICSDKTGTLTTNHMTVVKSCICMNVKEVSKTDSASSLCSEIPDSAVQLLLQSIFTNTGGEVVVNKDGKREILGTPTETALLEFGLSLGGDFQAERQTSKIVKVEPFNSSKKRMGVVLELPGGGLRVHSKGASEIVLSGCDKVVNSTGEVVPLDEESLNHLKLTIDQFANEALRTLCLAFMELETGFSPENPIPVSGYTLIAIVGIKDPVRPGVKESVAVCRSAGITVRMVTGDNINTAKAIARECGILTDDGIAIEGPVFREKTTEELMELIPKIQVMARSSPLDKHTLVKHLRTTFDEVVAVTGDGTNDAPALHEADIGLAMGIAGTEVAKESADVIILDDNFSTIATVAKWGRSVYINIQKFVQFQLTVNIVALIVNFSSACLTGSAPLTAVQLLWVNMIMDTLGALALATEPPTDELMKRPPVGKRGNFISNVMWRNILGQSLYQFMVISLLQAKGKAIFWLDGPDSTLVLNTLIFNSFVFCQIFNEISSREMEEINVFKGILDNYVFASVLGVTVFFQIIIVEFLGTFANTTPLTLTQWFASIVIGFIGMPIAAGLKTIQV

SEQ ID NO: 102 - protein, 1018 aa, Citrus trifoliata
MENYLNENFSDVKAKNTSEEALQRWRKLCGFVKNKKRRFRFTANLSKRFEAEAIRRSNQEKFRVAVLVSQAALQFIHGLNLSSEYTVPEEVAASGFQICPDELGSIVEGHDIKKLKVHGGVEGIAEKLSTSITDGISTSEQLLNRRKEIYGINKFTESPARGFWVYVWEALHDMTLMILAVCALVSLVVGIATEGWPKGAHDGLGIVMSILLVVFVTATSDYKQSLQFKDLDKEKKKITVQVARNGFRRKISIYDLLPGDIVHLCMGDQVPADGLFVSGFSVLINESSLTGESEPVNVNALNPFLLSGTKVQNGSCKMLVTTVGMRTQWGKLMATLSEGGDDETPLQVKLNGVATIIGKIGLFFAVVTFAVMVQGLFTRKLQEGTHWTWSGDDALEILEFFAIAVTIVVVAVPEGLPLAVTLSLAFAMKKMMNDKALVRHLAACETMGSATSICSDKTGTLTTNHMTVLKACICEEIKEVDNYKGTPAFGSSIPASASKLLLQSIFNNTGGEVVIGEGNKTEILGTPTETAILEFGLLLGGDFQAERQASKIVKVEPFNSVKKQMGVVIELPEGGFRVHCKGASEIILAACDKFLNANGEVVPLNEAAVNHLNKTIEKFASEALRTLCLAYMEIGNEFSADAPIPTQGYTCIGIVGIKDPMRPGVKESVAICRSAGITVRMVTGDNINTAKAIARECGILTDNGIAIEGPEFREKSDEELSKLIPKIQVMARSSPMDKHTLVKHLRTTLGEVVAVTGDGTNDAPALHEADIGLAMGIAGTEVAKESADVIILDDNFSTIVTVAKWGRSVYINIQKFVQFQLTVNVVALIVNFSSACLTGNAPLTAVQLLWVNMIMDTLGALALATEPPNGDLMKRSPVGRKGNFISNVMWRNILGQSLYQFLIIWYLQTRGKAVFHLDGPDPDLILNTLIFNTFVFCQVFNEISSREMEKINVLKGILKNYVFVAVLTCTVLFQIIIIELLGTFANTTPLNLQQWFVSILLGFLGMPIAAVLKLIHVG

SEQ ID NO: 103 - protein, 787 aa, Citrus trifoliata
MDKFFNWKDFDVEHKNPSEEALRRWRSAACIVKNRRRRFRMVADLDKRSDAEKKKLEIKQKIQVAIDVQREALRLTDAAGRAEYKLSEETRQAGFGTDPDDLAAIVCGHDTEGLKSNEGVEGVAQKLSVSLNEGVRKRDVPIRQNIYGVNRYTEKPPRSFFMFVWEALQDLTLIILMVCAGLSIGVGLAREGWPEGIYDGLGIILSKFLVVMVTAISDYKQSLQFRDLDREKKKIFIQVTRDGQRQKVCIYDLVVGDIVHLSIGDQVPADGIFISGHSLLIDESSLSGQSEPRYMYEENPFLLAGTEVQGGSGKMLVTTVGMRTEWGKLMETLNEGGEDETPLQVKLNGVATIIGKIELFFSVLEFLVLIGRFLGEKVIHNEFTDWSSADALTLIDYFAVVVTIIDVAVPEGLPLAVTLSLAFAVKKLMNDGALVRHLSACETMGSASCICTDKTGTLTTNHMVVDKIWICNTISKVEGNNREDILQLEISERVLDITLQAIFQNTGSEVVEDKDGKNSILGTPTESAILEFGLRLGGDFEAQRREFKLVKVEPFNSVRKKMSVLIALPAGGMRAFCKGASEIVLSMCDKVVSDNGEPVPLSEEQFRNITDVINGFASEALRTLCLAFKDLNDSSNENNIPDSGYTLIAVVGIKDPVRPGVKEAVQTCLEAGITVRMVTGDNINTARAIAKECGILTSDGEAVEGPEFRNMSPADIIPKLQVMARSLPSDKHTLVTQLRNTFGEVVAVTGDGTNDAAALHEADIGLAMGIAGTECKISAEQNKFIKK

SEQ ID NO: 104 - protein, 1039 aa, Citrus clementina
MENYLKKNFDVDPKRPSEEALMRWRSAVRVVKNPRRRFRMVADLAKRAEAERKRKKLQEKLRVALYVQKAALHFIDAGSRPIEYKLSQETLLAGYGIEPDELESIVRSHNSKAVESHGGVEGLAREVSVSLPDGVASEEVSNRQNVYGFNRYAEKPARSFWMFVWEALHDLTLIILMICAAVSIGVGIPTEGWPDGVYDGLGIVLSILLVVIVTAVSDYKQSLQFKALDKEKKNLIVQVTRDGYRKKLSIYDLVVGDIVHLSIGDQVPADGILISGYSLTIDESSLSGETEPVHINRDRPFLLSGTKVQDGSGKMLVTSVGMRTEWGRLMVTLSEGGEDETPLQVKLNGVATVIGKIGLVFAVLTFLVLALRFLVEKAQHHQIKNWSSIDAMKLLNYFAIAVTIVVVAVPEGLPLAVTLSLAFAMKKLMNDKALVRHLSACETMGSASCICTDKTGTLTTNHMVVTKLWICNEAKTIKSGDNEKLLKPSVSDAVFNIFLQSIFQNTGSEVVKDKDGRTNILGTPTERAILEFGLILGGDSTFHREESAIVKVEPFNSVKKRMSVLVSLPNNGGFRVFCKGASEIILNMCDKIINADGKAVPISEEQRKNLTNVINGFSSEALRTLCLAFQDIKGNHKAESIPENNYTLIAVVGIKDPVRPGVREAVETCLAAGITVRMVTGDNIHTAKAIAKECGILTDGGLAIEGTDFRSKNPQEMQELIPKLQVMARSSPTDKYILVTQLRNVFKEVVAVTGDGTNDAPALHEADIGLAMGIAGTEVAKENADVIIMDDNFTTIVTVARWGRSVYINIQKFVQFQLTVNIVALVINFVAACITGSAPLTAVQLLWVNMIMDTLGALALATEPPHEGLMQRPPIGRNVHFITVTMWRNIIGQSIYQIIVLGVLTFCGKKILKLSGPNATLILNTFIFNSFVFCQVFNEINSRDMEKINVFRGIFSSWVFVAVLVATVGFQVIIVELLGTFATTVPLNWKLWLASVVIGAISMPFGVLLKCIPVGTCTSAANSKHHDGYEPLPTGPDLA

SEQ ID NO: 105 - protein, 981 aa, Citrus sinensis
EKLRVALYVQKAALHFIDAGSRPIEYKLSQETLLAGYGIEPDELESIVRSHNSKAVESRGGVEGLAREVSVSLPDGVASEEVSNRQNVYGFNRYAEKPARSFWMFVWEALHDLTLIILMICAAVSIGVGIPTEGWPDGVYDGLGIVLSILLVVIVTAVSDYKQSLQFKALDKEKKNLIVQVTRDGYRKKLSIYDLVVGDIVHLSIGDQVPADGILISGYSLTIDESSLSGETEPVHINRDRPFLLSGTKVQDGSGKMLVTSVGMRTEWGRLMVTLSEGGEDETPLQVKLNGVATVIGKIGLVFAVLTFLVLALRFLVEKAQHHQIKHWSSIDAMKLLNYFAIAVTIVVVAVPEGLPLAVTLSLAFAMKKLMNDKALVRHLSACETMGSASCICTDKTGTLTTNHMVVTKLWICNEAKTIKSGDNEKLLKPSVSDAVFNIFLQSIFQNTGSEVVKDKDGRTNILGTPTERAILEFGLILGGDSTFHREESAIVKVEPFNSVKKRMSVLVSLPNNGGFRVFCKGASEIILNMCDKIINADGKAVPISEEQRKNLTNVINGFSSEALRTLCLAFQDIKGNHKAESIPENNYTLIAVVGIKDPVRPGVREAVETCLAAGITVRMVTGDNIHTAKAIAKECGILTDGGLAIEGTDFRSKNPQEMQELIPKLQVMARSSPTDKYILVTQLRNVFKEVVAVTGNGTNDAPALHEADIGLAMGIAGTEVAKENADVIIMDDNFTTIVTVARWGRSVYINIQKFVQFQLTVNIVALVINFVAACITGSAPLTAVQLLWVNMIMDTLGALALATEPPHEGLMQRPPIGRNVHFITVTMWRNIIGQSIYQIIVLGVLTFCGKKILKLSGPNATLILNTFIFNSFVFCQVFNEINSRDMEKINVFRGIFSSWVFIAVLVATVGFQVIIVELLGTFATTVPLNWKLWLASVVIGAISMPFGVLLKCIPVGTCTSAANSKHHDGYEPLPTGPDLA

SEQ ID NO: 106 - protein, 1036 aa, Citrus sinensis
MDKFLNWKDFDVEHKNPSEEALRRWRSAVSIVKNRRRRFRMVADLVKRSEGEKKKLKIQEKIRVALYVQKAALTFIDAAGRPEYKLSEETREVGFRIEPDDLAVIVRGRDIKGLKSNDGVEGVAQKLSVSLNEGVCKRDLPIRQKIYGVNRYTEKPPRSFLMFVWDALQDLTLIILIVCAVLSIGVGLATEGWPEGMYDGLGIILSILLVVMVTAISDYKQSLQFRDLDREKKKIFIQVTRDGQRQKVSIYDLVVGDIVHLSIGDQVAADGIFISGYSLLIDESSLSGESEPMYICEENPFLLAGTKVQDGSGKMLVTTVGMRTEWGKLMETLNEGGEDETPLQVKLNGVATIIGKIGLFFSVLTFLVLAGRFLGEKAIHNEFTVWSSADALTLIDYFAVAVTIIVVAVPEGLPLAVTLSLAFAMKKLMNDRALVRHLSACETMGSASCICTDKTGTLTTNHMVVDKIWICNTISKVEGNNREDILQLEISERVLDVTLQAIFQNTGSEVVKDKDGKNSILGTPTESAILEFGLHLGGDFEAQRREFKIVKVEPFNSVRKKMSVLIALPAGGMRAFCKGASEIVLSMCDKVVSDNGEPVPLSEEQFRNITDVINGFASEALRTLCLAFKDLNDSSNENNIPDSGYTLIAVVGIKDPVRPGVKEAVQTCLEAGITVRMVTGDNINTARAIAKECGILTSDGEAVEGPEFRNMSPADMKRIIPKLQVMARSLPLDKHTLVTQLRKTFGEVVAVTGDGTNDAPALHEADIGLSMGIAGTEVAKGNADVIILDDNFSTIVNVAKWGRAVYINIQKFVQFQLTVNVVALVINFVSACASGSAPLTAVQLLWVNMIMDTLGALALATEPPHEGLMKRPPVAKGESFITKVMWRNIIGQSIYQLIILVALNFDGKQILGLSGSDATAVLNTVIFNSFVFCQVFNEINSREMEKINVFKGMFDSWLFVGILVLTVAFQIIIVEFLGALASTVPLSWHLWLLCILIGAVSMPIAVVIKCIPVKKSEPKLQHHDGYEEIPSGPESA

SEQ ID NO: 107 - protein, 1036 aa, Citrus clementina
MDKFLNWKDFDVEHKNPSEEALRRWRSAVSIVKNRRRRFRMVADLVKRSEGEKKKLKIQEKIRVALYVQKAALQFIDAAGRPEYKLSEETREAGFRIEPDDLAAIVRGRDIKGLKSNDGVEGVAQKLSVSLNEGVCKRDLPIRQKIYGVNRYTEKPPRSFLMFVWDALQDLTLIILIVCAVLSIGVGLATEGWPEGMYDGLGIIVSILLVVMVTAISDYKQSLQFRDLDREKKKIFIQVTRDGQRQKVSIYDLVVGDIVHLSIGDQVAADGIFISGYSLLIDESSLSGESEPMYICEENPFLLAGTKVQDGSGKMLVTTVGMRTEWGKLMETLNEGGEDETPLQVKLNGVATIIGKIGLFFSVLTFLVLAGRFLGVKAIHNEFTVWSSADALTLIDYFAVAVTIIVVAVPEGLPLAVTLSLAFAMKKLMNDRALVRHLSACETMGSASCICTDKTGTLTTNHMVVDKIWICNTISKVEGNNREAILQLEISERVLDITLQAIFQNTGSEVVKDKDGKNSILGTPTESAILEFGLRLGGDFEAQRREFKIVKVEPFNSVRKKMSVLIALPAGGMRAFCKGASEIVLSMCDKVVSDNGEPVPLSEEQFRNITDVINGFASEALRTLCLAFKDLNDSSNENNIPDSGYTLIAVVGIKDPVRPGVKEAVQTCLEAGITVRMVTGDNINTARAIAKECGILTSDGEAVEGPEFRNMSPADMKRIIPKLQVMARSLPLDKHTLVTQLRKTFGEVVAVTGDGTNDAPALHEADIGLSMGIAGTEVAKGNADVIILDDNFSTIVNVAKWGRAVYINIQKFVQFQLTVNVVALVINFVSACASGSAPLTAVQLLWVNMIMDTLGALALATEPPHEGLMKRPPVAKGESFITKVMWRNIIGQSIYQLIILVALNFDGKQILGLSGSDATAVLNTVIFNSFVFCQVFNEINSREMEKINVFKGMFDSWMFVGILVLTVAFQIIIIEFLGAFASTVPLSWHQWLLCILIGAVSMPIAVVIKCIPVKKSEPKIQHHDGYEEIPSGPESA

SEQ ID NO: 108 - protein, 1026 aa, Citrus clementina
MDKFFNWKDFDVEHKNPSEEALRRWRSAASIVKNRRRRFRMVADLDKRSEAEKKKLEIKQKIQVAIDVQRAALQLTDAAGRAEYKLSEETRQAGFGIDPDDLAAIVCGHDIEGLKSNEGVEGVAQKLSVSLNEGVHKRDVPIRQNIYGVNRYTEKPPRSFFMFVWEALQDLTLIILMVCAGLSIGVGLAREGWPEGIYDGIFLVVLGIILSKFLVVMVTAISDYKQSLQFRDLDREKKKIFIQVTRDGQRQKVCTYDLVVGDIVHLSIGDQVPAYGIFISGHSLLIDESSLSGQSEPRYMYEENPFLLAGTKVQGGSGKMLVTTVGMRTEWGKLMETLNEGGEDETPLQVKLNGVATIIGKIELFFSVLEFLVLIGRFLGEKVIHNEFTDWSSADALTLIDYFAVVVTIIDVAVPEGLPLAVTLSLAFAMKKLMNDRALVRHLSACETMGSASCICTDKTRMLTTNHMVVDKIWIANTISNVEGNNRKDILQSEISERVLDITLQAIFQNTGSEVVKDKDGKNSILGTPTESAILEFGLRLGGDFEAQRREFKIVKVEPFNSVRKKMSVLIALPAGGMRAFCKGASEIVLSMCDKVVSDNGEPVPLSEEQFRNITDVINGFASEALRTLCLAFKDLNDSSNENNIPDSGYTLIAVVGIKDPVRPGVKEAVQTCLEAGITVRMVTGNNINTARAIAKECGILTSDGEAVEGPEFRNMSPADIIPKLQVMARSLPSDKHTLVTQLRNTFGEVVAVTGDGTNDASALHEADIGLAMGIAGTEVAKGNADVIILDDNFSTIVNVAKWGRAVYINIQKFVQFQLTVNVVALVINFVSACASGSAPLTAVQLLWVNMIMDTLGALALATEPPHEGLMKRPPVAKGESFITKVMWRNIIGQSIYQLIILVVLNFDGKQILRLSGSDASAVLNTVIFNSFVFFQVFNEINSRDMEKINVFKGMFDSWMFVGILVLTVAFQIIIVEFLGAFASTVPLSWQLWLLCILIGAGSMPIAAVIKCVPVKKCEPKLQRHD

SEQ ID NO: 109 - protein, 875 aa, Citrus clementina
MFVWDALQDLTLIILIVCAVLSIGVGLATEGWPEGMYDGLGIIVSILLVVMVTAISDYKQSLQFRDLDREKKKIFIQVTRDGQRQKVSIYDLVVGDIVHLSIGDQVAADGIFISGYSLLIDESSLSGESEPMYICEENPFLLAGTKVQDGSGKMLVTTVGMRTEWGKLMETLNEGGEDETPLQVKLNGVATIIGKIGLFFSVLTFLVLAGRFLGVKAIHNEFTVWSSADALTLIDYFAVAVTIIVVAVPEGLPLAVTLSLAFAMKKLMNDRALVRHLSACETMGSASCICTDKTGTLTTNHMVVDKIWICNTISKVEGNNREAILQLEISERVLDITLQAIFQNTGSEVVKDKDGKNSILGTPTESAILEFGLRLGGDFEAQRREFKIVKVEPFNSVRKKMSVLIALPAGGMRAFCKGASEIVLSMCDKVVSDNGEPVPLSEEQFRNITDVINGFASEALRTLCLAFKDLNDSSNENNIPDSGYTLIAVVGIKDPVRPGVKEAVQTCLEAGITVRMVTGDNINTARAIAKECGILTSDGEAVEGPEFRNMSPADMKRIIPKLQVMARSLPLDKHTLVTQLRKTFGEVVAVTGDGTNDAPALHEADIGLSMGIAGTEVAKGNADVIILDDNFSTIVNVAKWGRAVYINIQKFVQFQLTVNVVALVINFVSACASGSAPLTAVQLLWVNMIMDTLGALALATEPPHEGLMKRPPVAKGESFITKVMWRNIIGQSIYQLIILVALNFDGKQILGLSGSDATAVLNTVIFNSFVFCQVFNEINSREMEKINVFKGMFDSWMFVGILVLTVAFQIIIIEFLGAFASTVPLSWHQWLLCILIGAVSMPIAVVIKCIPVKKSEPKIQHHDGYEEIPSGPESA

SEQ ID NO: 110 - protein, 1018 aa, Citrus sinensis
MENYLNENFSDVKAKNTSEEALQRWRKLCGFVKNKKRRFRFTANLSKRFEAEAIRRSNQEKFRVAVLVSQAALQFIHGLNLSSEYTVPEEVAASGFQICPDELGSIVEGHDIKKLKVHGGVEGIAEKLSTSITDGISTSEHLLNRRKEIYGINKFTESPARGFWVYVWEALHDMTLMILAVCALVSLVVGIATEGWPKGAHDGLGIVMSILLVVFVTATSDYKQSLQFKDLDREKKKITVQVARNGFRRKISIYDLLPGDIVHLCMGDQVPADGLFVSGFSVLINESSLTGESEPVNVNALNPFLLSGTKVQNGSCKMLVTTVGMRTQWGKLMATLSEGGDDETPLQVKLNGVATIIGKIGLFFAVVTFAVMVQGLFTRKLQEGTHWTWSGDDALEILEFFAIAVTIVVVAVPEGLPLAVTLSLAFAMKKMMNDKALVRHLAACETMGSATSICSDKTGTLTTNHMTVLKACICEEIKEVDNSKGTPAFGSSIPASASKLLLQSIFNNTGGEVVIGEGNKTEILGTPTETAILEFGLLLGGDFQAERQASKIVKVEPFNSVKKQMGVVIELPEGGFRVHCKGASEIILAACDKFLNSNGEVVPLNEAAVNHLNETIEKFASEALRTLCLAYMEIGNEFSADAPIPTEGYTCIGIVGIKDPMRPGVKESVAICRSAGITVRMVTGDNINTAKAIARECGILTDNGIAIEGPEFREKSDEELSKLIPKIQVMARSSPMDKHTLVKHLRTTLGEVVAVTGDGTNDAPALHEADIGLAMGIAGTEVAKESADVIILDDNFSTIVTVAKWGRSVYINIQKFVQFQLTVNVVALIVNFSSACLTGNAPLTAVQLLWVNMIMDTLGALALATEPPNGDLMKRSPVGRKGNFISNVMWRNILGQSLYQFLIIWYLQTRGKAVFRLDGPDPDLILNTLIFNTFVFCQVFNEISSREMEKINVFKGILKNYVFVAVLTCTVLFQIIIIELLGTFANTTPLNLQQWFVSILLGFLGMPIAAVLKLIQVG

SEQ ID NO: 111 - protein, 1018 aa, Citrus unshiu
MENYLNENFSDVKAKNTSEEALQRWRKLCGFVKNRKRRFRFTANLSKRFEAEAIRRSNQEKFRVAVLVSQAALQFIHGLNLSSEYTVPEEVAASGFQICPDELGSIVEGHDIKKLKVHGGVEGIAEKLSTSITDGISTSEHLLNRRKEIYGINKFTESPARGFWVYVWEALHDMTLMILAVCALVSLVVGIATEGWPKGAHDGLGIVMSILLVVFVTATSDYKQSLQFKDLDREKKKITVQVARNGFRRKISIYDLLPGDIVHLCMGDQVPADGLFVSGFSVLINESSLTGESEPVNVNALNPFLLSGTKVQNGSCKMLVTTVGMRTQWGKLMATLSEGGDDETPLQVKLNGVATIIGKIGLFFAVVTFAVMVQGLFTRKLQEGTHWTWSGDDALEILEFFAIAVTIVVVAVPEGLPLAVTLSLAFAMKKMMNDKALVRHLAACETMGSATSICSDKTGTLTTNHMTVLKACICEEIKEVDNSKGTPAFGSSIPASASKLLLQSIFNNTGGEVVIGEGNKTEILGTPTETAILEFGLLLGGDFQAERQASKIVKVEPFNSVKKQMGVVIELPEGGFRVHCKGASEIILAACDKFLNSNGEVVPLNEAAVNHLNETIEKFASEALRTLCLAYMEIGNEFSADAPIPTEGYTCIGIVGIKDPMRPGVKESVAICRSAGITVRMVTGDNINTAKAIARECGILTDNGIAIEGPEFREKSDEELSKLIPKIQVMARSSPMDKHTLVKHLRTTLGEVVAVTGDGTNDAPALHEADIGLAMGIAGTEVAKESADVIILDDNFSTIVTVAKWGRSVYINIQKFVQFQLTVNVVALIVNFSSACLTGNAPLTAVQLLWVNMIMDTLGALALATEPPNGDLMKRSPVGRKGNFISNVMWRNILGQSLYQFLIIWYLQTRGKAVFRLDGPDPDLILNTLIFNTFVFCQVFNEISSREMEKINVFKGILKNYVFVAVLTCTVLFQIIIIELLGTFANTTPLNLQQWFVSILLGFLGMPIAAVLKLIQVG

SEQ ID NO: 112 - protein, 1015 aa, Citrus sinensis
MESYLQENFGVKPKHSSTEALEKWRNLCGVVKNPKRRFRFTANLSKRYEAAAMRKTNQEKLRIAVLVSKAAIQFLLGVTPSDYNVPEEVKAAGFQVCAEELGSITEGHDVKKLKFHGGVTGIAEKLSTSISDGLTSNTDLFNRRQEIYGLNQFAESTPRSFWVFVWEALQDMTLMILGACAFVSLIVGIVMEGWPHGAHDGLGIVASILLVVFVTATSDYRQSLQFKDLDKEKKKIYVQVTRNGFRQKLSIYDLLPGDIVHLGIGDQVPADGLFVSGFSVLIDESSLTGESEPVMVNEENPFMLSGTKLQDGSCKMMVTTVGMRTQWGKLMATLSEGGDDETPLQVKLNGVATIIGKGGLFFAVVTFAVLVQGLLSHKLGEGSIWSWSGDDALKLLEYFAVAVTIVVVAVPEGLPLAVTLSLAFAMKKMMNDKALVRHLAACETMGSASSICSDKTGTLTTNHMTVVKSCICMNVKEVSKTDSASSLCSEIPDSAVQLLLQSIFTNTGGEVVVNKDGKREILGTPTETALLEFGLSLGGDFQAERQTSKIVKVEPFNSSKKRMGVVLELPGGGLRAHSKGASEIVLSGCDKVVNSTGEVVPLDEESLNHLKLTIDQFANEALRTLCLAFMELETGFSPENPIPVSGYTLIAIVGIKDPVRPGVKESVAVCRSAGITVRMVTGDNINTAKAIARECGILTDDGIAIEGPVFREKTTEELMELIPKIQVMARSSPLDKHTLVKHLRTTFDEVVAVTGDGTNDAPALHEADIGLAMGIAGTEVAKESADVIILDDNFSTIATVAKWGRSVYINIQKFVQFQLTVNIVALIVNFSSACLTGSAPLTAVQLLWVNMIMDTLGALALATEPPTDELMKRPPVGKRGNFISNVMWRNILGQSLYQFMVISLLQAKGKAIFWLDGPDSTLVLNTLIFNSFVFCQIFNEISSREMEEINVFKGILDNYVFASVLGVTVFFQIIIVEFLGTFANTTPLTLTQWFASIVIGFIGMPIAAGLKTIQV

SEQ ID NO: 113 - protein, 1018 aa, Citrus clementina
MENYLNENFSDVKAKNTSEEALQRWRKLCGFVKNRKRRFRFTANLSKRFEAEAIRRSNQEKFRVAVLVSQAALQFIHGLNLSSEYTVPEEVAASGFQICPDELGSIVEGHDIKKLKVHGGVEGIAEKLSTSITDGISTSEHLLNRRKEIYGINKFTESPARGFWVYVWEALHDMTLMILAVCALVSLVVGIATEGWPKGAHDGLGIVMSILLVVFVTATSDYKQSLQFKDLDREKKKITVQVARNGFRRKISIYDLLPGDIVHLCMGDQVPADGLFVSGFSVLINESSLTGESEPVNVNALNPFLLSGTKVQNGSCKMLVTTVGMRTQWGKLMATLSEGGDDETPLQVKLNGVATIIGKIGLFFAVVTFAVMVQGLFTRKLQEGTHWTWSGDDALEILEFFAIAVTIVVVAVPEGLPLAVTLSLAFAMKKMMNDKALVRHLAACETMGSATSICSDKTGTLTTNHMTVLKACICEEIKEVDNSKGTPAFGSSIPASASKLLLQSIFNNTGGEVVIGEGNKTEILGTPTETAILEFGLLLGGDFQAERQASKIVKVEPFNSVKKQMGVVIELPEGGFRVHCKGASEIILAACDKFLNSNGEVVPLNEAAVNHLNETIEKFASEALRTLCLACMEIGNEFSADAPIPTEGYTCIGIVGIKDPMRPGVKESVAICRSAGITVRMVTGDNINTAKAIARECGILTDNGIAIEGPEFREKSDEELSKLIPKIQVMARSSPMDKHTLVKHLRTTLGEVVAVTGDGTNDAPALHEADIGLAMGIAGTEVAKESADVIILDDNFSTIVTVAKWGRSVYINIQKFVQFQLTVNVVALIVNFSSACLTGNAPLTAVQLLWVNMIMDTLGALALATEPPNGDLMKRSPVGRKGNFISNVMWRNILGQSLYQFLIIWYLQTRGKAVFRLDGPDPDLILNTLIFNTFVFCQVFNEISSREMEKINVFKGILKNYVFVAVLTCTVLFQIIIIELLGTFANTTPLNLQQWFVSILLGFLGMPIAAVLKLIQVG

SEQ ID NO: 114 - protein, 1015 aa, Citrus sinensis
MESYLQENFGVKPKHSSTEALEKWRNLCGVVKNPKRRFRFTANLSKRYEAAAMRKTNQEKLRIAVLVSKAAIQFLLGVTPSDYNVPEEVKAAGFQVCAEELGSITEGHDVKKLKFHGGVTGIAEKLSTSISDGLTSNTDLFNRRQEIYGLNQFAESTPRSFWVFVWEALQDMTLMILGACAFVSLIVGIVMEGWPHGAHDGLGIVASILLVVFVTATSDYRQSLQFKDLDKEKKKIYVQVTRNGFRQKLSIYDLLPGDIVHLGIGDQVPADGLFVSGFSVLIDESSLTGESEPVMVNEENPFMLSGTKLQDGSCKMMVTTVGMRTQWGKLMATLSEGGDDETPLQVKLNGVATIIGKGGLFFAVVTFAVLVQGLLSHKLGEGSIWSWSGDDALKLLEYFAVAVTIVVVAVPEGLPLAVTLSLAFAMKKMMNDKALVRHLAACETMGSASSICSDKTGTLTTNHMTVVKSCICMNIKEVSKTDSASSLCSEIPDSAVQLLLQSIFTNTGGEVVVNKDGKREILGTPTETALLEFGLSLGGDFQAERQTSKIVKVEPFNSSKKRMGVVLELPGGGLRAHSKGASEIVLSGCDKVVNSTGEVVPLDEESLNHLKLTIDQFANEALRTLCLAFMELETGFSPENPIPVSGYTLIAIVGIKDPVRPGVKESVAVCRSAGITVRMVTGDNINTAKAIARECGILTDDGIAIEGPVFREKTTEELMELIPKIQVMARSSPLDKHTLVKHLRTTFDEVVAVTGDGTNDAPALHEADIGLAMGIAGTEVAKESADVIILDDNFSTIATVAKWGRSVYINIQKFVQFQLTVNIVALIVNFSSACLTGSAPLTAVQLLWVNMIMDTLGALALATEPPTDELMKRPPVGKRGNFISNVMWRNILGQSLYQFMVISLLQAKGKAIFWLDGPDSTLVLNTLIFNSFVFCQIFNEISSREMEEINVFKGILDNYVFASVLGVTVFFQIIIVEFLGTFANTTPLTLTQWFASIVIGFIGMPIAAGLKTIQV

SEQ ID NO: 115 - protein, 1015 aa, Citrus clementina
MESYLQENFGVKPKHSSTEALEKWRNLCGVVKNPKRRFRFTANLSKRYEAAAMRKTNQEKLRIAVLVSKAAIQFLLGVTPSDYNVPEEVKAAGFQVCAEELGSITEGHDVKKLKFHGGVTGIAEKLSTSISDGLTSNTDLFNRRQEIYGLNQFAESTPRSFWVFVWEALQDMTLMILGACAFVSLIVGIVMEGWPHGAHDGLGIVASILLVVFVTATSDYRQSLQFKDLDKEKKKIYVQVTRNGFRQKLSIYDLLPGDIVHLGIGDQVPADGLFVSGFSVLIDESSLTGESEPVMVNEENPFMLSGTKLQDGSCKMMVTTVGMRTQWGKLMATLSEGGDDETPLQVKLNGVATIIGKGGLFFAVVTFAVLVQGLLSHKLGEGSIWSWSGDDALKLLEYFAVAVTIVVVAVPEGLPLAVTLSLAFAMKKMMNDKALVRHLAACETMGSASSICSDKTGTLTTNHMTVVKSCICMNVKEVSKTDSASSLCSEIPDSAVQLLLQSIFTNTGGEVVVNKDGKREILGTPTETALLEFGLSLGGDFQAERQTSKIVKVEPFNSSKKRMGVVLELPGGGLRAHSKGASEIVLSGCDKVVNSTGEVVPLDEESLNHLKLTIDQFANEALRTLCLAFMELETGFLPENPIPVSGYTLIAIVGIKDPVRPGVKESVAVCRSAGITVRMVTGDNINTAKAIARECGILTDDGIAIEGPVFREKTTEELMELIPKIQVMARSSPLDKHTLVKHLRTTFDEVVAVTGDGTNDAPALHEADIGLAMGIAGTEVAKESADVIILDDNFSTIATVAKWGRSVYINIQKFVQFQLTVNIVALIVNFSSACLTGSAPLTAVQLLWVNMIMDTLGALALATEPPTDELMKRPPVGKRGNFISNVMWRNILGQSLYQFMVISLLQAKGKAIFWLDGPDSTLELNTLIFNSFVFCQIFNEISSREMEEINVFKGILDNYVFASVLGVTVFFQIIIVEFLGTFANTTPLTLTQWFASIVIGFIGMPIAAGLKTIQV

SEQ ID NO: 116 - protein, 938 aa, Citrus sinensis
MDKFLNWKDFDVEHKNPSEEALRRWRSAVSIVKNPRRRFRMVADLDKRSEAEKKKLEIKVISDKDKSQATNMVACTAMARGFPTSQKDISPQKNLTLIILMVCAGLSIGVGLAREGWPEGIYDGLGIILSKFLVVMVTAISDYKQSLQFRDLDREKKKIFIQVTRDGQRQKVSIYDLVVGDIVHLSIGDQVAADGIFISGHSLLIDESSLSGESEPMYIYVEKFKDGSGKMLVTTVGMRTEWGKLMETLNEGSEDETPLQVKLNGVATIIGKIELFFSVLEFLVLVGRFLGEKVIHNEFTDWSSADALTLIDYLAVVVTLIDVAVPEGLPLAVILSLAFAVKKLMNDGALVRHLSACEAMGSSNCICTDKTGMLTTNHMVVDKIWGHGNTISNVEGNNREEILQSEISERVLDITLQAIFQNTGSEVVKDKDGKNSILRTPTESTVLEFGLRLGGNFEAQRREFKIIKVEPFNSVGKRMSVLTALPEGGMRAFCKGASEIVLSMCDKVVSDNGEPVPLSEEQFRNITDVINGFASEALRTLCLAFKDLNDSSDENNIPDSGYTLIAVVGIKDPVRPGVKEAVQTCLEAGITVRMVTGDNINTARAIAKECGILTSDGEAVEGPELRNMSPADMKRIIPKLQVMARSLPLDKHTLVTQLRNTFGEFVAVTGDGTNDAPALHEADIGLSMGIAGTEVAKQNADVIILDDNFSTIVNVAKWGRAVYINIQKFLQFQLTINVVINFVSACASGSAPLTAVQVLWVNMIMDTLGALALATEPPHEGLMKRPPVAKGESLITKVMWRNIIGQCIYQLIILVVLNFDGKQLLGLSGSGATAVLNTVIFNSFVFCQLFNEINSREMEKINVFKGMFNSWMFVGILVLTVAFQIIIVEFLGAFASTVPLRWQLWLLSILIGAVSMPIAAVIKCIPVKKCEPKLQRHD

SEQ ID NO: 117 - protein, 950 aa, Citrus sinensis
MENYLNENFSDVKAKNTSEEALQRWRKLCGFVKNRKRRFRFTANLSKRFEAEAIRRSNQEKFRVAVLVSQAALQFIHGLNLSSEYTVPEEVAASGFQICPDELGSIVEGHDIKKLKVHGGVEGIAEKLSTSITDGISTSEHLLNRRKEIYGINKFTESPARGFWVYVWEALHDMTLMILAVCALVSLVVGIATEGWPKGAHDGLGIVMSILLVVFVTATSDYKQSLQFKDLDREKKKITVQVARNGFRRKISIYDLLPGDIVHLCMGDQVPADGLFVSGFSVLINESSLTGESEPVNVNALNPFLLSGTKVQNGSCKMLVTTVGMRTQWGKLMATLSEGGDDETPLQVKLNGVATIIGKIGLFFAVVTFAVMVQGLFTRKLQEGTHWTWSGDDALEILEFFAIAVTIVVVAVPEGLPLAVTLSLAFAMKKMMNDKALVRHLAACETMGSATSICSDKTGTLTTNHMTVLKACICEEIKEVDNSKGTPAFGSSIPASASKLLLQSIFNNTGGEVVIGEGNKTEILGTPTETAILEFGLLLGGDFQAERQASKIVKVEPFNSVKKQMGVVIELPEGGFRVHCKGASEIILAACDKFLNSNGEVVPLNEAAVNHLNETIEKFASEALRTLCLACMEIGNEFSADAPIPTEGYTCIGIVGIKDPMRPGVKESVAICRSAGITVRMVTGDNINTAKAIARECGILTDNGIAIEGPEFREKSDEELSKLIPKIQVMARSSPMDKHTLVKHLRTTLGEVVAVTGDGTNDAPALHEADIGLAMGIAGTEVAKESADVIILDDNFSTIVTVAKWGRSVYINIQKFVQFQLTVNVVALIVNFSSACLTGNAPLTAVQLLWVNMIMDTLGALALATEPPNGDLMKRSPVGRKGNFISNVMWRNILGQSLYQFLIIWYLQTRGKAVFRLDGPDPDLILNTLIFNTFVFCQVCLSTCIRSTEP

SEQ ID NO: 118 - protein, 991 aa, Citrus sinensis
MENYLNENFSDVKAKNTSEEALQRWRKLCGFVKNRKRRFRFTANLSKRFEAEAIRRSNQEKFRVAVLVSQAALQFIHGLNLSSEYTVPEEVAASGFQICPDELGSIVEGHDIKKLKVHGGVEGIAEKLSTSITDGISTSEHLLNRRKEIYGINKFTESPARGFWVYVWEALHDMTLMILAVCALVSLVVGIATEGWPKGAHDGLGIVMSILLVVFVTATSDYKQSLQFKDLDREKKKITVQVARNGFRRKISIYDLLPGDIVHLCMGDQVPADGLFVSGFSVLINESSLTGESEPVNVNALNPFLLSGTKVQNGSCKMLVTTVGMRTQWGKLMATLSEGGDDETPLQVKLNGVATIIGKIGLFFAVVTFAVMVQGLFTRKLQEGTHWTWSGDDALEILEFFAIAVTIVVVAVPEGLPLAVTLSLAFAMKKMMNDKALVRHLAACETMGSATSICSDKTGTLTTNHMTVLKACICEEIKEVDNSKGTPAFGSSIPASASKLLLQSIFNNTGGEVVIGEGNKTEILGTPTETAILEFGLLLGGDFQAERQASKIVKVEPFNSVKKQMGVVIELPEGGFRVHCKGASEIILAACDKFLNSNGEVVPLNEAAVNHLNETIEKFASEALRTLCLACMEIGNEFSADAPIPTEGYTCIGIVGIKDPMRPGVKESVAICRSAGITVRMVTGDNINTAKAIARECGILTDNGIAIEGPEFREKSDEELSKLIPKIQVMARSSPMDKHTLVKHLRTTLGEVVAVTGDGTNDAPALHEADIGLAMGIAGTEVAKESADVIILDDNFSTIVTVAKWGRSVYINIQKFVQFQLTVNVVALIVNFSSACLTGNAPLTAVQLLWVNMIMDTLGALALATEPPNGDLMKRSPVGRKGNFISNVMWRNILGQSLYQFLIIWYLQTRGKAVFRLDGPDPDLILNTLIFNTFVFCQLQRDGKDKRLQGYTEELCLCSCAHLHRSFSNNNHRAPGYICKYNSSQFATVVC

SEQ ID NO: 119 - protein, 845 aa, Citrus sinensis
MTLMILAVCALVSLVVGIATEGWPKGAHDGLGIVMSILLVVFVTATSDYKQSLQFKDLDREKKKITVQVARNGFRRKISIYDLLPGDIVHLCMGDQVPADGLFVSGFSVLINESSLTGESEPVNVNALNPFLLSGTKVQNGSCKMLVTTVGMRTQWGKLMATLSEGGDDETPLQVKLNGVATIIGKIGLFFAVVTFAVMVQGLFTRKLQEGTHWTWSGDDALEILEFFAIAVTIVVVAVPEGLPLAVTLSLAFAMKKMMNDKALVRHLAACETMGSATSICSDKTGTLTTNHMTVLKACICEEIKEVDNSKGTPAFGSSIPASASKLLLQSIFNNTGGEVVIGEGNKTEILGTPTETAILEFGLLLGGDFQAERQASKIVKVEPFNSVKKQMGVVIELPEGGFRVHCKGASEIILAACDKFLNSNGEVVPLNEAAVNHLNETIEKFASEALRTLCLACMEIGNEFSADAPIPTEGYTCIGIVGIKDPMRPGVKESVAICRSAGITVRMVTGDNINTAKAIARECGILTDNGIAIEGPEFREKSDEELSKLIPKIQVMARSSPMDKHTLVKHLRTTLGEVVAVTGDGTNDAPALHEADIGLAMGIAGTEVAKESADVIILDDNFSTIVTVAKWGRSVYINIQKFVQFQLTVNVVALIVNFSSACLTGNAPLTAVQLLWVNMIMDTLGALALATEPPNGDLMKRSPVGRKGNFISNVMWRNILGQSLYQFLIIWYLQTRGKAVFRLDGPDPDLILNTLIFNTFVFCQVFNEISSREMEKINVFKGILKNYVFVAVLTCTVLFQIIIIELLGTFANTTPLNLQQWFVSILLGFLGMPIAAVLKLIQVG

SEQ ID NO: 120 - protein, 815 aa, Citrus unshiu
MENYLKKNFDVDPKRPSEEALMRWRSAVRVVKNPRRRFRMVADLAKRAEAERKRKKLQEKLRVALYVQKAALHFIDVSNRQNVYGFNRYAEKPARSFWMFVWEALHDLTLIILMICAAVSIGVGIPTEGWPDGVYDGLGIVLSILLVVIVTAVSDYKQSLQFKALDKEKKNLIVQVTRDGYRKKLSIYDLVVGDIVHLSIGDQVPADGILISGYSLTIDESSLSGETEPVHINRDRPFLLSGTKVQDGSGKMLVTSVGMRTEWGRLMVTLSEGGEDETPLQVKLNGVATVIGKIGLVFAVLTFLVLALRFLVEKAQHHQIKNWSPIDAMKLLNYFAIAVTIVVVAVPEGLPLAVTLSLAFAMKKLMNDKALVRHLSACETMGSASCICTDKTGTLTTNHMVVTKLWICNEAKTIKSGDNEKLLKPSVSDANTGSEVVKDKDGRTNILGTPTERAILEFGLILGGDSTFHREESAIVKVEPFNSVKKRMSVLVSLPNNGGFRVFCKGASEIILNMCDKIINADGKAVPISEEQRKNLTNVINGFSSEALRTLCLAFQDIKGNHKAESIPENNYTLIAVVGIKDPVRPGVREAFQLTVNIVALVINFVAACITGSAPLTAVQLLWVNMIMDTLGALALATEPPHEGLMQRPPIGRNVHFITVTMWRNIIGQSIYQIIVLGVLTFCGKKILKLSGPNATLILNTFIFNSFVFCQVFNEINSRDMEKINVFRGIFSSWVFVAVLVATVGFQVIIVELLGTFATTVPLNWKLWLASVVIGAISMPFGVLLKCIPVGTCTSAANSKHHDGYEPLPTGPDLA

SEQ ID NO: 121 - protein, 840 aa, Citrus sinensis
MENYLNENFSDVKAKNTSEEALQRWRKLCGFVKNRKRRFRFTANLSKRFEAEAIRRSNQEKFRVAVLVSQAALQFIHGLNLSSEYTVPEEVAASGFQICPDELGSIVEGHDIKKLKVHGGVEGIAEKLSTSITDGISTSEHLLNRRKEIYGINKFTESPARGFWVYVWEALHDMTLMILAVCALVSLVVGIATEGWPKGAHDGLGIVMSILLVVFVTATSDYKQSLQFKDLDREKKKITVQVARNGFRRKISIYDLLPGDIVHLCMGDQVPADGLFVSGFSVLINESSLTGESEPVNVNALNPFLLSGTKVQNGSCKMLVTTVGMRTQWGKLMATLSEGGDDETPLQVKLNGVATIIGKIGLFFAVVTFAVMVQGLFTRKLQEGTHWTWSGDDALEILEFFAIAVTIVVVAVPEGLPLAVTLSLAFAMKKMMNDKALVRHLAACETMGSATSICSDKTGTLTTNHMTVLKACICEEIKEVDNSKGTPAFGSSIPASASKLLLQSIFNNTGGEVVIGEGNKTEILGTPTETAILEFGLLLGGDFQAERQASKIVKVEPFNSVKKQMGVVIELPEGGFRVHCKGASEIILAACDKFLNSNGEVVPLNEAAVNHLNETIEKFASEALRTLCLACMEIGNEFSADAPIPTEGYTCIGIVGIKDPMRPGVKESVAICRSAGITVRMVTGDNINTAKAIARECGILTDNGIAIEGPEFREKSDEELSKLIPKIQVMARSSPMDKHTLVKHLRTTLGEVVAVTGDGTNDAPALHEADIGLAMGIAGTEVAKESADVIILDDNFSTIVTVAKWGRSVYINIQKFVQFQLTVNVVALIVNFSSACLTGK

SEQ ID NO: 122 - protein, 787 aa, Citrus unshiu
MESYLQENFGVKPKHSSTEALEKWRNLCGVVKNPKRRFRFTANLSKRYEAAAMRKTNQEKLRIAVLVSKAAIQFLLGVTPSDYNVPEEVKAAGFQVCAEELGSITEGHDVKKLKFHGGVTGIAEKLSTSISDGLTSNTDLFNRRQEIYGLNQFAESTPRSFWVFVWEALQDMTLMILGACAFVSLIVGIVMEGWPHGAHDGLGIVASILLVVFVTATSDYRQSLQFKDLDKEKKKIYVQVTRNGFRQKLSIYDLLPGDIVHLGIGDQVPADGLFVSGFSVLIDESSLTGESEPVMVNEENPFMLSGTKLQDGSCKMMVTTVGMRTQWGKLMATLSEGGDDETPLQVKLNGVATIIGKGGLFFAVVTFAVLVQGLLSHKLGEGSIWSWSGDDALKLLEYFAVAVTIVVVAVPEGLPLAVTLSLAFAMKKMMNDKALVRHLAACETMGSASSICSDKTGTLTTNHMTVVKSCICMNVKEVSKTDSASSLCSEIPDSAVQLLLQSIFTNTGGEVVVNKDGKREILGTPTETALLEFGLSLGGDFQAERQTSKIVKVEPFNSSKKRMGVVLELPGGGLRAHSKGASEIVLSGCDKVVNSTGEVVPLDEESLNHLKLTIDQFANEALRTLCLAFMELETGFLPENPIPVSGYTLIAIVGIKDPVRPGVKESVAVCRSAGITVRMVTGDNINTAKAIARECGILTDDGIAIEGPVFREKTTEELMELIPKIQVMARSSPLDKHTLVKHLRTTFDEVVAVTGDGTNDAPALHEADIGLAMGIAGTEVSTLQMIS

SEQ ID NO: 123 - protein, 799 aa, Citrus sinensis
MENYLNENFSDVKAKNTSEEALQRWRKLCGFVKNRKRRFRFTANLSKRFEAEAIRRSNQEKFRVAVLVSQAALQFIHGLNLSSEYTVPEEVAASGFQICPDELGSIVEGHDIKKLKVHGGVEGIAEKLSTSITDGISTSEHLLNRRKEIYGINKFTESPARGFWVYVWEALHDMTLMILAVCALVSLVVGIATEGWPKGAHDGLGIVMSILLVVFVTATSDYKQSLQFKDLDREKKKITVQVARNGFRRKISIYDLLPGDIVHLCMGDQVPADGLFVSGFSVLINESSLTGESEPVNVNALNPFLLSGTKVQNGSCKMLVTTVGMRTQWGKLMATLSEGGDDETPLQVKLNGVATIIGKIGLFFAVVTFAVMVQGLFTRKLQEGTHWTWSGDDALEILEFFAIAVTIVVVAVPEGLPLAVTLSLAFAMKKMMNDKALVRHLAACETMGSATSICSDKTGTLTTNHMTVLKACICEEIKEVDNSKGTPAFGSSIPASASKLLLQSIFNNTGGEVVIGEGNKTEILGTPTETAILEFGLLLGGDFQAERQASKIVKVEPFNSVKKQMGVVIELPEGGFRVHCKGASEIILAACDKFLNSNGEVVPLNEAAVNHLNETIEKFASEALRTLCLACMEIGNEFSADAPIPTEGYTCIGIVGIKDPMRPGVKESVAICRSAGITVRMVTGDNINTAKAIARECGILTDNGIAIEGPEFREKSDEELSKLIPKIQVMARSSPMDKHTLVKHLRTTLGEVVAVTGDGTNDAPALHEADIGLAMGIAGTEVELECCCFNFSSRKTYIL

SEQ ID NO: 124 - protein, 838 aa, Citrus trifoliata
MLEKEDDLGNPRGSCQLPGSRKMFWRSASWSSSRTASQNPETEERDLADPSGTNIVNSNGRRFPVPLTPRSQQNSKARSCLPPLQPLSIARRSLDEWPKASSDDVGEWHQPPTPSGNKSGERLKLDLSSIQRNSDKNGGLVKRDKIAFFDKECSKVAEHIYLGGDAVARDRDILKQHGITHILNCVGFVCPEYFKADFVYRTLWLQDSPSEDITSILYDVFDYFEDVREKGGRVFVHCCQGVSRSTSLVIAYLMWREGQSFDDAFQYVKAARGIADPNMGFACQLLQCQKRVHAFPLSPSSLLRMYRIAPHSPYDPLHLVPKMLNDPTPSALDSRGAFIVHIPAAIYIWIGKHCESIMERDARGAVCQLVRYERAQGRIVIIKEGEEPGYFWDAFSNFLPLMDKSRNGVEIRESTIKMVPGERKVNSYDVDYEIFRKAIMGGFVPPFSSSENEHETHLPARESSWSALRRKFASGDMKEFVSVPKISLCRVYSESMMLVHSSSPSSSTSSLLSSSSSPPYLSPDSLCSDSSTSSKCSSESSMDSPSAASCSLPVSSTLSNFSNLSLHSFKNSSEDIPNKPETCGSQPPLSPVKRISPSLAERRGSLSKSLKLPVMTSNVRANSSLDLLASQEDGASRSDNTYTLCNSDSIDIVFKSKSAIRNGEEDATQMCKLKISPSSVDTAELCHKVSSSANNCVDSGRNYSWREGLKANRLDESVPDHCNQMQPLIYRWPTFERVGKFDLSALNSKSAFAIFSPSRDSGKSAARVLYFWVGRSFCHGKSQIQLDNNKELGNIEGSDQNQFGYDILTRMGLPKDTPIKIVKEDEEPREFLALLSAP

SEQ ID NO: 125 - protein, 836 aa, Citrus clementina
MLEKEDDLGNPRGSCQLPGSRKMFWRSASWSSSRTASQNPETEERDLADPSGSNIVNSNGRRFPVPLTPRSQQNSKARSCLPPLQPLSIARRSLDEWPKASSDDVGEWHQPPTPSGNKSGERLKLDLSSIQRNSDKNGGLVKRDKIAFFDKECSKVAEHIYLGGDAVARDRDILKQHGITHILNCVGFVCPEYFKADFVYRTLWLQDSPSEDITSILYDVFDYFEDVREKGGRVFVHCCQGVSRSTSLVIAYLMWREGQSFDDAFQYVKAARGIADPNMGFACQLLQCQKRVHAFPLSPSSLLRMYRIAPHSPYDPLHLVPKMLNDPTPLALDSRGAFIVHIPAAIYIWIGKHCESIMERDARGAVCQLVRYERAQGRIVIIKEGEEPGYFWDAFSNFLPLMDKSRNGVEIRESTIKMVPGERKVNSYDVDYEIFRKAIMGGFVPPFSSSENEHETHLPARESSWSALRRKFASGDMKEFVSVPKISLCRVYSESMMLVHSSSPSSSTSSLLSSSSSPPYLSPDSVCSDSSTSSKCSSESSMDSPSAASCSLPVSSTLSIFSNLSLHSFKNSSEDNKPETCGSQPPLSPVKRISPSLAERRGSLSKSLKLPVMTSNVRANSSLDLLASQEDVASRSDNTYTLCNSDSIDIVFKSKSAIRNGEEDATQMCKLKISPSSVDTAELCHKVSSSANNCVDSGRNYSWREGLKANRLDESVPDHCNQMQPLIYRWPTFERVGKFDSSALNSKSAFAIFSPSRDSGKSAARVLYFWVGRSFCHGKSPIQLDNNKELGNIEGSDQNQFGYDILTRMGLPKDTPIKIIKEDEEPREFLALLSTP

SEQ ID NO: 126 - protein, 836 aa, Citrus sinensis
MLEKEDDLGNPRGSCQLPGSRKMFWRSASWSSSRTASQNPETEERDLADPSGSNIVNSNGRRFPVPLTPRSQQNSKARSCLPPLQPLSIARRSLDEWPKASSDDVGEWHQPPTPSGNKSGERLKLDLSSIQRNSDKNGGLVKRDKIAFFDKECSKVAEHIYLGGDAVARDRDILKQHGITHILNCVGFVCPEYFKADFVYRTLWLQDSPSEDITSILYDVFDYFEDVREKGGRVFVHCCQGVSRSTSLVIAYLMWREGQSFDDAFQYVKAARGIADPNMGFACQLLQCQKRVHAFPLSPSSLLRMYRIAPHSPYDPLHLVPKMLNDPTPLALDSRGAFIVHIPAAIYIWIGKHCESIMERDARGAVCQLVRYERAQGRIVIIKEGEEPGYFWDAFSNFLPLMDKSRNGVEIRESTIKMVPGERKVNSYDVDYEIFRKAIMGGFVPPFSSSENEHETHLPARESSWSALRRKFASGDMKEFVSVPKISLCRVYSESMMLVHSSSPSSSTSSLLSSSSSPPYLSPDSVCSDSSTSSKCSSESSMDSPSAASCSLPVSSTLSIFSNLSLHSFKNSSEDNKPETCGSQPPLSPVKRISPSLAERRGSLSKSLKLPVMTSNVRANSSLDLLASQEDVASRSDNTYTLCNSDSIDIVFKSKSAIRNGEEDATQMCKLKISPSSVDTAELCHKVSSSANNCVDSGRNYSWREGLKANRLDESVPDHCNQMQPLIYRWPTFERVGKFDSSALNSKSAFAIFSPSRDSGKSAARVLYFWVGRSFCHGESPIQLDNNKELGNIEGSDQNQFGYDILTRMGLPKDTPIKIIKEDEEPREFLALLSTP

SEQ ID NO: 127 - protein, 820 aa, Citrus sinensis
MLEKEDDLGNPRGSCQLPGSRKMFWRSASWSSSRTASQNPETEERDLVDPSGSNIVNSNGRRFPVPLTPRSQQNSKARSCLPPLQPLSIARRSLDEWPKASSDDVGEWHQPPTPSGNKSGERLKLDLSSIQRNSDKNGGLVKRDKIAFFDKECSKVAEHIYLGGDAVARDRDILKQHGITHILNCVGFVCPEYFKADFVYRTLWLQDSPSEDITSILYDVFDYFEDVREKGGRVFVHCCQGVSRSTSLVIAYLMWREGQSFDDAFQYVKAARGIADPNMGFACQLLQCQKRVHAFPLSPSSLLRMYRIAPHSPYDPLHLVPKMLNDPTPSALDSRGAFIVHIPAAIYIWIGKHCESIMERDARGAVCQLVRYERAQGRIVIIKEGEEPGYFWDAFSNFLPLMDKSRNGVEIRESTIKMVPGERKVNSYDVDYEIFRKAIMGGFVPPFSSSENEHETHLPARESSWSALRRKFASGDMKEFVSVPKISLCRVYSESMMLVHSSSPSSSTSSLLSSSSSPPYLSPDSVCSDSSTSSKCSSESSMDSPSAASCSLPVSSTLSNFSNLSLRSFKNSSEDIPNKPETCGSQPPLSPVKRISPSLAERRGSLSKSLKLPVMTSNVRANSSLDLLASQEDVASRSDNTYTLCNSDSIDIVFKSKSAIRNGEEDATQMCKLKISPSSVDTAELCHKVSSSANNCVDSGRNYSWREGLKANRLDESVPDHCNQMQPLIYRWPTFERVGKFDSSALNSKSAFAIFSPSRDSGKSAARVLYFWVGRSFCHGKSRIQLDNNKELGNIEGSDQNQFGYDILTRMGLPKDTPIK

SEQ ID NO: 128 - protein, 831 aa, Citrus sinensis
MVGEEDNNKHVDRLSGGSGNRRAYLRSVSWTDRSPNKPNPIPRPQPNSKARSLLPPLQPLSINRRPVEQWPRAGSDDLGVWPNPQTPRGSVQLNPLESSSSELQPVKEFEFKKDKLAFFDKECSRIADHIYLGSDAVAKNRGILRQNGITHVLNCVGFVCPEYFKGDLVYKTLWLQDSPSEDITSILYDVFDYFEDVREQGGRVFVHCCQGVSRSTSLVIAYLMWREGQSFEDAFQDVKAARGVTNPNMGFACQLLLCQKRVHAMPASPNSMLRIYRIAPHSSYDPLHLVPKLLNYPVAQGFDTRGAFIVLVPSAIYVWIGKNCSVMMSNRAREAANQVIRYEKAQGQITSIKEGEEPLEFWDALVRGQFFADGCNKEEVKNEQVSFSGSNKIATLMQDGAGEIDEYDLDFELFHKALDGGVVPPFSVSNAGSETCVPARESGWCRLRRKFVNGLMREFVASKLNCATSAVNDESNMIIDTGKASEDAVSLAGFASPSSPPADVCGSPDSFDCFPNVSPNRISPQLSSKSPTLSPSTSDYSSSFTFSPSSCNWSDLSRQPSPSGLEATDSSHSLCEETAFSLSKVFSPNHTSGVANSCFPCKGNFPSIAERRGSNPPPRLLPSAGKPSIVPRNLVRSWSFSLTDLENDEVKDMDNNQIVHEGDREELMLNADLACASNDSHDKIKDKKEYDRVHFSLGTIDKRMGVANPVLYQWPALSKVESSSFQVLDSRSVYILLAPDTSLGTNESGILYVWLGCEVLCEKGQSQLVSNNCTCKHGHLQLETIGHNIINQMGLPADASVQIVREGEEPEQFLNHLNCFSFQKASNSANH

SEQ ID NO: 129 - protein, 832 aa, Citrus sinensis
MVGEEDNNKHVDRLSGGSGNRRAYLRSVSWTDRSPNKPNPIPRPQPNSKARSLLPPLQPLSINRRPVEQWPRAGSDDLGVWPNPQTPRGSVQLNPLESSSSELQPVKEFEFKKDKLAFFDKECSRIADHIYLGSDAVAKNRGILRQNGITHVLNCVGFVCPEYFKGDLVYKTLWLQDSPSEDITSILYDVFDYFEDVREQGGRVFVHCCQGVSRSTSLVIAYLMWREGQSFEDAFQDVKAARGVTNPNMGFACQLLLCQKRVHAMPASPNSMLRIYRIAPHSSYDPLHLVPKLLNYPVAQGFDTRGAFIVLVPSAIYVWIGKNCSVMMSNRAREAANQVIRYEKAQGQITSIKEGEEPLEFWDALVRGQFFADGCNKEEVKNEQVSFSGSNKIATLMQDGAGEIDEYDLDFELFHKALDGGVVPPFSVSNAGSETCVPARESGWCRLRRKFVNGLMREFVASKLNCATSAVNDESNMIIDTGKASEDAVSLAGFASPSSPPADVCGSPDSFDCFPNVSPNRISSPQLSSKSPTLSPSTSDYSSSFTFSPSSCNWSDLSRQPSPSGLEATDSSHSLCEETAFSLSKVFSPNHTSGVANSCFPCKGNFPSIAERRGSNPPPRLLPSAGKPSIVPRNLVRSWSFSLTDLENDEVKDMDNNQIVHEGDREELMLNADLACASNDSHDKIKDKKEYDRVHFSLGTIDKRMGVANPVLYQWPALSKVESSSFQVLDSRSVYILLAPDTSLGTNESGILYVWLGCEVLCEKGQSQLVSNNCTCKHGHLQLETIGHNIINQMGLPADASVQIVREGEEPEQFLNHLNCFSFQKASNSANH

SEQ ID NO: 130 - protein, 422 aa, Citrus trifoliata
MAKLNPSFLSLTLLTIFLTIASAHVFFEERFDDGWESRWVKSDWKTDENTAGEWNYTAGKWNGDPNDKGIQTSEDYRFYAISAEFPEFSNKDKTLVFQFSVKHEQKLDCGGGYMKLLSGEVDQKKFGGDTPYSIMFGPDICGYSTKKVHAILTYNGTNKLIKKEVPCETDQLTHVYTFILRPDASYSILIDNVEKQSGSLYSDWDLLPPKTIKDPDAKKPEDWDDKEYIPDPEDKKPEGYDDIPKEITDPDAKKPDDWDDEEDGEWTAPTIPNPEYKGPWKPKKIKNPNYKGKWKAPMIDNPDFKDDPDLYVYPNLKYVGIELWQVKSGTMFDNVLVSDDPEYAKKLAEETWGKHKDAEKAAFDEAEKKREEEESKDAPDSDAEDNDDDDTEDDDDADADADAETKSDSSSGDSDKDVHDEL

SEQ ID NO: 131 - protein, 418 aa, Citrus clementina
MAKLNPSFLSLTLLTIFLTIASAHVFFEERFDDGWESRWVTSDWKKDENTAGEWNYTAGKWNGDPNDKGIQTSEDYRFYAISAEFPEFSNKDKTLVFQFSVKHEQKLDCGGGYMKLLSGEVDQKKFGGDTPYSIMFGPDICGYSTKKVHAILTYNGTNKLIKKEVPCETDQLTHVYTFILRPDATYSILIDNVEKQSGSLYSDWDLLPPKTIKDPDAKKPEDWDDKEYIPDPEDKKPEGYDDIPKEITDPDAKKPDDWDDEEDGEWTAPTIPNPEYKGPWKPKKIKNPNYKGKWKAPMIDNPDFKDDPDLYVYPNLKYVGIELWQVKSGTMFDNVLVSDDPEYANKLAEETWGKHKDAEKAAFDEAEKKREEEESKDAPDSDAEDNDDDDTEDDDDADTETKSDSSSGDADKDVHDEL

SEQ ID NO: 132 - protein, 472 aa, Citrus unshiu
YIQSSFTPHSTEHFLSLALKMAKLNPSFLSLTLLTIFLTIASAHVFFEERFDDGWESQWVKSDWKKDENTAGEWNYTAGKWNGDPNDKGIQTSEDYRFYAISAEFPEFSNKDKTLVFQFSVKHEQKLDCGGGYMKLLSGEVDQKKFGGDTPYSIMFGPDICGYSTKKVHAILTYNGTNKLIKKEVPCETDQLTHVYTFILRPDATYSILIDNVEKQSGSLYSDWDLLPPKTIKDPDAKKPEDWDDKEYIPDPEDKKPEGYDDIPKEITDPDAKKPDDWDDEEDGEWTAPTIPNPEYKGPWKPKKIKNPNYKGKWKAPMIDNPDFKDDPDLYVYPNLKYVGIELWQVKSGTMFDNVLVSDDPEYANKLAEETWGKHKDAEKAAFDEAEKKREEENEQIVKKPEPPPAPSPVRSLNALKIGAYATTRSAAGEPVPYSSNVVKKHVPFSVANNGSYRCSESLLLRRPDEFLCPLD

SEQ ID NO: 133 - protein, 358 aa, Citrus clementina
MAKLNPSFLSLTLLTIFLTIASAHVFFEERFDDGWESRWVTSDWKKDENTAGEWNYTAGKWNGDPNDKGIQTSEDYRFYAISAEFPEFSNKDKTLVFQFSVKHEQKLDCGGGYMKLLSGEVDQKKFGGDTPYSIMFGPDICGYSTKKVHAILTYNGTNKLIKKEVPCETDQLTHVYTFILRPDATYSILIDNVEKQSGSLYSDWDLLPPKTIKDPDAKKPEDWDDKEYIPDPEDKKPEGYDDIPKEITDPDAKKPDDWDDEEDGEWTAPTIPNPEYKGPWKPKKIKNPNYKGKWKAPMIDNPDFKDDPDLYVYPNLKYVGIELWQVKSGTMFDNVLVSDDPEYANKLAEETWGKHKDV

SEQ ID NO: 134 - protein, 417 aa, Citrus unshiu
YIQSSFTPHSTEHFLSLALKMAKLNPSFLSLTLLTIFLTIASAHVFFEERFDDGWESQWVKSDWKKDENTAGEWNYTAGKWNGDPNDKGIQTSEDYRFYAISAEFPEFSNKDKTLVFQFSVKHEQKLDCGGGYMKLLSGEVDQKKFGGDTPYSIMFGPDICGYSTKKVHAILTYNGTNKLIKKEVPCETDQLTHVYTFILRPDATYSILIDNVEKQSGSLYSDWDLLPPKTIKDPDAKKPEDWDDKEYIPDPEDKKPEGYDDIPKEITDPDAKKPDDWDDEEDGEWTAPTIPNPEYKGPWKPKKIKNPNYKGKWKAPMIDNPDFKDDPDLYVYPNLKYVGIELWQVKSGTMFDNVLVSDDPEYANKLAEETWGKHKDAEKAAFDEAEKKREEEVLFCSITLLHILFFLWNWVFSILS

SEQ ID NO: 135 - protein, 378 aa, Citrus unshiu
YIQSSFTPHSTEHFLSLALKMAKLNPSFLSLTLLTIFLTIASAHVFFEERFDDGWESQWVKSDWKKDENTAGEWNYTAGKWNGDPNDKGIQTSEDYRFYAISAEFPEFSNKDKTLVFQFSVKHEQKLDCGGGYMKLLSGEVDQKKFGGDTPYSIMFGPDICGYSTKKVHAILTYNGTNKLIKKEVPCETDQLTHVYTFILRPDATYSILIDNVEKQSGSLYSDWDLLPPKTIKDPDAKKPEDWDDKEYIPDPEDKKPEGYDDIPKEITDPDAKKPDDWDDEEDGEWTAPTIPNPEYKGPWKPKKIKNPNYKGKWKAPMIDNPDFKDDPDLYVYPNLKYVGIELWQVKSGTMFDNVLVSDDPEYANKLAEETWGKHKDV

SEQ ID NO: 136 - protein, 418 aa, Citrus sinensis
MAKLNPSSLSLTLLIIFLTIASAHVFFEERFDDGWESQWVKSDWKKDENTAGEWNYTAGKWNGDPNDKGIQTSEDYRFYAISAEFPEFSNKDKTLVFQFSVKHEQKLDCGGGYMKLLSGEVDQKKFGGDTPYSIMFGPDICGYSTKKVHAILTYNGTNKLIKKEVPCETDQLTHVYTFILRPDATYSILIDNAEKQSGSLYSDWDLLPPKTIKDPDAKKPEDWDDKEYIPDPEDKKPEGYDDIPKEITDPDAKKPDDWDDEEDGEWTAPTIPNPEYKGPWKPKKIKNPNYKGKWKAPMIDNPDFKDDPDLYVYPNLKYVGIELWQVKSGTMFDNVLVSDDPEYAKKLAEETWGKHKDAEKAAFDEAEKKREEEESKDAPDSDAEDNDDDDTEDDDDADAETKSDSSSGDADKDVHDEL

SEQ ID NO: 137 - protein, 283 aa, Citrus sinensis
MAKLNPSFLSLTLLTIFLTIASAHVFFEERFDDGWESRWVTSDWKKDENTAGEWNYTAGKWNGDPNDKGIQTSEDYRFYAISAEFPEFSNKDKTLVFQFSVKHEQKLDCGGGYMKLLSGEVDQKKFGGDTPYSIMFGPDICGYSTKKVHAILTYNGTNKLIKKEVPCETDQLTHVYTFILRPDATYSILIDNAEKQSGSLYSDWDLLPPKTIKDPDAKKPEDWDDKEYIPDPEDKKPEGYDDIPKEITDPDAKKPDDWDDEEDGEWTAPTIPNPEYKGPWKPK

SEQ ID NO: 138 - protein, 395 aa, Citrus trifoliata
MPPTTTVSASSSFTLFRVPSSSSTKLKPTTTYIQIPNRFFPKHPTFKMTTTTIRAAVSIEKETPETERPPTFLRESDDKESSSSSASSVRARFEKMIRDAQDSVCQAIEKTDGGGKFKEDVWSRPGGGGGISRVLQDGAIWEKAGVNVSVVYGVMPPEAYRAAKAAASDEKPGPIPFFAAGISSVLHPKNPFAPTLHFNYRYFETDAPKDTPGAPRQWWFGGGTDLTPAYIFEEDVKHFHSTQKSACDKFDPTFYPRFKKWCDDYFYIKHRGERRGLGGIFFDDLNDYDQEMLLSFATECANSVIPAYIPIIEKRKDTPFTDQHKAWQQLRRGRYVEFNLVYDRGTTFGLKTGGRIESILVSLPLTARWEYDHNPEEGSEEWKLLDACINPKEWI

SEQ ID NO: 139 - protein, 395 aa, Citrus clementina
MPPTTAVSASSSFTLFRVPSSSSTKLKPTTTYIQIPNRFFPKHPTFKMTTTTIRAAVSIEKETPETERPPTFLRESDDKESSSSSASSVRARFEKMIRDAQDSVCQAIEKTDGGGKFKEDVWSRPGGGGGISRVLQDGAIWEKAGVNVSVVYGVMPPEAYRAAKAAASDEKPGPIPFFAAGISSVLHPKNPFAPTLHFNYRYFETDAPKDTPGAPRQWWFGGGTDLTPAYIFEEDVKHFHSTQKSACDKFDPTFYPRFKKWCDDYFYIKHRGERRGLGGLFFDDLNDYDQEMLLSFATECANSVIPAYIPIIEKRKDTPFTDQHKAWQQLRRGRYVEFNLVYDRGTTFGLKTGGRIESILVSLPLTARWEYDHNPKEGSEEWKLLDACINPKEWI

SEQ ID NO: 140 - protein, 395 aa, Citrus sinensis
MPPTTAVSASSSFTLFRVPSSWSTKLKPTTTYIQIPNRFFPKHPTFKMTTTTIRAAVSIEKETPETERPPTFLRESDDKESSSSSASSVRARFEKMIRDAQDSVCQAIEKTDGGGKFKEDVWSRPGGGGGISRVLQDGAIWEKAGVNVSVVYGVMPPEAYRAAKAAASDEKPGPIPFFAAGISSVLHPKNPFAPTLHFNYRYFETDAPKDTPGAPRQWWFGGGTDLTPAYIFEEDVKHFHSTQKSACDKFDPTFYPRFKKWCDDYFYIKHRGERRGLGGLFFDDLNDYDQEMLLSFATECANSVIPAYIPIIEKRKDTPFTDQHKAWQQLRRGRYVEFNLVYDRGTTFGLKTGGRIESILVSLPLTARWEYDHNPKEGSEEWKLLDACINPKEWI

SEQ ID NO: 141 - protein, 431 aa, Citrus sinensis
MPPTTAVSASSSFTLFRVPSSWSTKLKPTTTYIQIPNRFFPKHPTFKMTTTTIRAAVSIEKETPETERPPTFLRESDDKESSSSSASSVRARFEKMIRDAQDSVCQAIEKTDGGGKFKEDVWSRPGGGGGISRVLQDGAIWEKAGVNVSVVYGVMPPEAYRAAKAAASDEKPGPIPFFAAGISSVLHPKNPFAPTLHFNYRYFETDAPKDTPGAPRQWWFGGGTDLTPAYIFEEDVKHFHSTQKSACDKFDPTFYPRFKKWCDDYFYIKHRGERRGLGGLFFDDLNDYDQEMLLSFATECANSVIPAYIPIIEKRKDTPFTDQHKAWQQLRRGRYVEFNLVYDRGTTFGLKTGGRIESILVSLPLTARWEYDHVSFLEHSGEYASDVTKSLKSWTDEGSFFFFSLFSMQNPKEGSEEWKLLDACINPKEWI

SEQ ID NO: 142 - protein, 415 aa, Citrus sinensis
MPPTTAVSASSSFTLFRVPSSWSTKLKPTTTYIQIPNRFFPKHPTFKMTTTTIRAAVSIEKETPETERPPTFLRESDDKESSSSSASSVRARFEKMIRDAQDSVCQAIEKTDGGGKFKEDVWSRPGGGGGISRVLQDGAIWEKAGVNVSVVYGVMPPEAYRAAKAAASDEKPGPIPFFAAGISSVLHPKNPFAPTLHFNYRYFETDAPKDTPGAPRQWWFGGGTDLTPAYIFEEDVKHFHSTQKSACDKFDPTFYPRFKKWCDDYFYIKHRGERRGLGGLFFDDLNDYDQEMLLSFATECANSVIPAYIPIIEKRKDTPFTDQHKAWQQLRRGRYVEFNLVYDRGTTFGLKTGGRIESILVSLPLTARWEYDHVSFLEHSGEYASDVTKSLKSWTDEGSFFFFFLVFYAEPERGK

SEQ ID NO: 143 - protein, 347 aa, Citrus sinensis
MPPTTAVSASSSFTLFRVPSSWSTKLKPTTTYIQIPNRFFPKHPTFKMTTTTIRAAVSIEKETPETERPPTFLRESDDKESSSSSASSVRARFEKMIRDAQDSVCQAIEKTDGGGKFKEDVWSRPGGGGGISRVLQDGAIWEKAGVNVSVVYGVMPPEAYRAAKAAASDEKPGPIPFFAAGISSVLHPKNPFAPTLHFNYRYFETDAPKDTPGAPRQWWFGGGTDLTPAYIFEEDVKHFHSTQKSACDKFDPTFYPRFKKWCDDYFYIKHRGERRGLGGLFFDDLNDYDQEMLLSFATECANSVIPAYIPIIEKRKDTPFTDQHKAWQQLRRGRYVEFNLVSNSPED

SEQ ID NO: 144 - protein, 1080 aa, Citrus trifoliata
MASPTSGRLAITPSSRVLQSPLSDESIWKRLKEAGFDEESIKRRDKAALIAYIAKLETEIFEHQHHMGLLILEKKELASKYEQIKASAEAAELLQKHDQASHLSAIAEARKREESLKKTLGVEKECIASLEKAVHEIRAESAETKVAADSKFAEARCMVENAQKKFAEAEAKLHAAEPLQAEANRYHRSAERKLQEVVAREDDLSRRIASFKADCEEKEREIIRERQSLSDRKKILQQEHERLLDAQTLLNEREDHILSKLQELSRKEKELEASRANVEEKFKALNEEKSNLDLTLVSLSKREEAVIEREASLQKKEQKLLVSQETLASKESNEIQKIIANHESALRVKQSEFEAELAIKYKLAEDEIEKKRRAWELRDLDLSQREESLLEREHDLEVQSRALVDKEKDLVERSHLLEEKENKLIAFEKEADLKKSLLQKEKEEVNIIKSDLQKSLSSLDEKKKQLNCAKDKLEAMKSEAGELSVLEIKLKEELDVVRAQKLELMVETDKLELEKAKFEAEWEMIDEKREELRKEAERVAVERVVVSKSLKDERDSLRQERDAMRDQHKRDVDSLNREREEFMNKMVHEHSEWFTKIQQERADFLLGIEMQKRDLENCIEKRREELESSFREREKAFEEEKMRELQQISSLKEKAEKELEQVTLEIKRLDLERMEINMDRQRRDREWAELNNSIEELKVQRQKLKEQRQLLHADREEIQAESERLKKLEDLKIAVDYMAVSEMQRSRLEHSQKKISAKRHLNQQTSVAHADFGSDQKFDVTNNGDRFNTPSVQKTASASPPSLARFSWIKRFADLVFKHSGENSVENDEEKSPTSDHEDASLTINSRKRQPVRYSFGEPKVILEVPSENEVVKRTVDLESENNQNAAQKCKQSVSEDGIHAARKRRVDVDCVDPSELLMQNNKRRKQQEDFPRNSSEEAINHGAVAEQSNLPEDQHTLTSKNKSNVPEGLHTLTSNNHIQGGNEEASILIVDKIIKISEVTCEMTDADNFINQEKIDGSQNSVAESVQDIVKVGGTNDHSTSAHTDDVILPYVSEIDGMGQEKQMGNVKDLTECGQAQNE

SEQ ID NO: 145 - protein, 1116 aa, Citrus clementina
MASPSSGRLSITPSSRVLQSPLSDESIWKRLKEAGLDEESIKRRDKAALIAYIAKLETEIFEHQHHMGLLILEKKELASKYEQIKASAEAAELLQKHDQASHLSAIAEARKREESLKKTLGVEKECIASLEKAVHEIRAESAETKVAADSKFAEARCMVENAQKKFAEAEAKLHASESLQAEANRYHRSAERKLQDVVAREDDLSRRIASFKADCEEKEREIIRERQSLSDRKKILQQEHERLLDAQTLLNEREDHILSKLQELSRKEKELEASRANVEEKFKALNEEKSNLDLTLVSLLKREEAVIEREASLQKKEQKLLVSQETLASKESNEIQKIIANHESALRVKQSEFEAELAIKYKLAEDEIEKKRRAWELRDLDLGQREESLLEREHDLEVQSRALVDKEKDLVERSHLLEEKENKLIAFEKEADLKKSLLQKEKEEVNIIKSDLQKSLSSLDEKKKQVNCAKDKLEAMKSEAGELSVLEIKLKEELDVVRAQKLELMVETDKLQLEKAKFEAEWEMIDEKREELRKEAESVAVERVVVSKSLKDERDSLRQERDAMRDQHKRDVDSLNREREEFMNKMVHEHSEWFTKIQQERADFLLGIEMQKRDLENCIEKRREELESSFREREKAFEEEKMRELQQISSLKEKAEKELEQVTLEIKRLDLERMEINMDRQRRDREWAELNNSIEELKVQRQKLEEQRQLLHADREEIQAESERLKKLEDLKIAVDYMAVSEMQRSRLEHSQKKISAKRHLNQQTSLAHADLGSDQKFDVTNNGDRFNTPSVQKTASASPPSLARFSWIKRFADLVFKHSGENSIENDEEKSPTSDHEDASLTINSRKRQPVRYSFGEPKVILEVPSENEVVKRTVDLESENNQNAAQKCKQSVSEDGIHAARKRRVDVDCVDPSELLMQNNKRRKQQEDFPRNSSEEAINHGAVAEQSNLPEDQHTLTSKNKSNVPEGLHTLTSNNHTQGGNEEASILIVDKIIKISEVTCEMPDADNFINQEKIDGSQNSVAESVQDIVKVGGTNDHSTPAHTDDVVLPYVSEIDGMVQEKQMGNVKDLTECGQAQVLMFLHTSFLYIILAYDSCSLFLHDLLVCLYDGISCFC

SEQ ID NO: 146 - protein, 1116 aa, Citrus sinensis
MASPSSGRLAITPSSRVLQSPLSDESIWKRLKEAGLDEVSIKRRDKAALIAYIAKLETEIFEHQHHMGLLILEKKELASKYEQIKASAEAAELLQKHDRASHLSAIAEARKREESLKKTLGVEKECIASLEKAVHEIRAESAETKVAADSKFAEARCMVENAQKKFAEAEAKLHAAESLQAEANRYHRSAERKLQEVVAREDDLSRRIASFKADCEEKEREIIRERQSLSDRKKILQQEHERLLDAQTLLNEREDHILSKLQELSRKEKELEASRANVEEKFKALNEEKSNLDLTLVSLLKREEAVIEREASLQKKEQKLLVSQETLASKESNEIQKIIANHESALRVKQSEFEAELAIKYKLAEDEIEKKRRAWELRDLDLGQREESLLEREHDLEVQSRALVDKEKDLVERSHLLEEKENKLIAFEKEADLKKSLLQKEKEEVNIIKSDLQKSLSSLDEKKKQVNCAKDKLEAMKSEAGELSVLEIKLKEELDVVRAQKLELMVETDKLQLEKAKFEAEWEMIDEKREELRKEAERVAVERVVVSKSLKDERDSLRQERDAMRDQHKRDVDSLNREREEFMNKMVHEHSEWFTKIQQERADFLLGIEMQKRDLENCIEKRREELESSFREREKAFEEEKMREFQQISSLKEKAEKELEQVTLEIKRLDLERMEINMDRQRRDREWAELNNSIEELMVQRQKLEEQRQLLHADREEIQAESERLKKLEDLKIAVDYMAVSEMQRSRLEHSQKKISAKRHLNQQTSLAHADLGSDQKFDVTNNGDRFNTPSVQKTASASPPSLARFSWIKRFADLVFKHSGENSVENDEEKSPTSDHEDASLTINSRKRQPVRYSFGEPKVILEVPSENEVVKRTVDLESENNQNAAQKCKQSVSEDGIHAARKRRVDVDCVDPSELLMQNNKRRKQQEDFPRNSSEEAINHGAVAEQSNLPEDQHTLTSKNKSNVPEGLHTLTSNNHTQGGNEEASILIVDKIIKISEVTCEMTDADNFINQEKIDGSQNSVAESVQDIVKVGGTNDHSTPAHTDDVVLPYISEIDGMVQEKQMGNVKDLTECGQAQVLMFLHTSFLYIILAYDSCSLFLHDLLVCLYDGISYFC

SEQ ID NO: 147 - protein, 1113 aa, Citrus clementina
MASPSSGRLSITPSSRVLQSPLSDESIWKRLKEAGLDEESIKRRDKAALIAYIAKLETEIFEHQHHMGLLILEKKELASKYEQIKASAEAAELLQKHDQASHLSAIAEARKREESLKKTLGVEKECIASLEKAVHEIRAESAETKVAADSKFAEARCMVENAQKKFAEAEAKLHASESLQAEANRYHRSAERKLQDVVAREDDLSRRIASFKADCEEKEREIIRERQSLSDRKKILQQEHERLLDAQTLLNEREDHILSKLQELSRKEKELEASRANVEEKFKALNEEKSNLDLTLVSLLKREEAVIEREASLQKKEQKLLVSQETLASKESNEIQKIIANHESALRVKQSEFEAELAIKYKLAEDEIEKKRRAWELRDLDLGQREESLLEREHDLEVQSRALVDKEKDLVERSHLLEEKENKLIAFEKEADLKKSLLQKEKEEVNIIKSDLQKSLSSLDEKKKQVNCAKDKLEAMKSEAGELSVLEIKLKEELDVVRAQKLELMVETDKLQLEKAKFEAEWEMIDEKREELRKEAESVAVERVVVSKSLKDERDSLRQERDAMRDQHKRDVDSLNREREEFMNKMVHEHSEWFTKIQQERADFLLGIEMQKRDLENCIEKRREELESSFREREKAFEEEKMRELQQISSLKEKAEKELEQVTLEIKRLDLERMEINMDRQRRDREWAELNNSIEELKVQRQKLEEQRQLLHADREEIQAESERLKKLEDLKIAVDYMAVSEMQRSRLEHSQKKISAKRHLNQQTSLAHADLGSDQKFDVTNNGDRFNTPSVQKTASASPPSLARFSWIKRFADLVFKHSGENSIENDEEKSPTSDHEDASLTINSRKRQPVRYSFGEPKVILEVPSENEVVKRTVDLESENNQNAAQKCKQSVSEDGIHAARKRRVDVDCVDPSELLMQNNKRRKQQEDFPRNSSEEAINHGAVAEQSNLPEDQHTLTSKNKSNVPEGLHTLTSNNHTQGGNEEASILIVDKIIKISEVTCEMPDADNFINQEKIDGSQNSVAESVQDIVKVGGTNDHSTPAHTDDVVLPYVSEIDGMVQEKQMGNVKDLTECGQAQNEIGEHKLECELVQSDNSKKNKELIAYRTRSKQKK

SEQ ID NO: 148 - protein, 1113 aa, Citrus sinensis
MASPSSGRLAITPSSRVLQSPLSDESIWKRLKEAGLDEVSIKRRDKAALIAYIAKLETEIFEHQHHMGLLILEKKELASKYEQIKASAEAAELLQKHDRASHLSAIAEARKREESLKKTLGVEKECIASLEKAVHEIRAESAETKVAADSKFAEARCMVENAQKKFAEAEAKLHAAESLQAEANRYHRSAERKLQEVVAREDDLSRRIASFKADCEEKEREIIRERQSLSDRKKILQQEHERLLDAQTLLNEREDHILSKLQELSRKEKELEASRANVEEKFKALNEEKSNLDLTLVSLLKREEAVIEREASLQKKEQKLLVSQETLASKESNEIQKIIANHESALRVKQSEFEAELAIKYKLAEDEIEKKRRAWELRDLDLGQREESLLEREHDLEVQSRALVDKEKDLVERSHLLEEKENKLIAFEKEADLKKSLLQKEKEEVNIIKSDLQKSLSSLDEKKKQVNCAKDKLEAMKSEAGELSVLEIKLKEELDVVRAQKLELMVETDKLQLEKAKFEAEWEMIDEKREELRKEAERVAVERVVVSKSLKDERDSLRQERDAMRDQHKRDVDSLNREREEFMNKMVHEHSEWFTKIQQERADFLLGIEMQKRDLENCIEKRREELESSFREREKAFEEEKMREFQQISSLKEKAEKELEQVTLEIKRLDLERMEINMDRQRRDREWAELNNSIEELMVQRQKLEEQRQLLHADREEIQAESERLKKLEDLKIAVDYMAVSEMQRSRLEHSQKKISAKRHLNQQTSLAHADLGSDQKFDVTNNGDRFNTPSVQKTASASPPSLARFSWIKRFADLVFKHSGENSVENDEEKSPTSDHEDASLTINSRKRQPVRYSFGEPKVILEVPSENEVVKRTVDLESENNQNAAQKCKQSVSEDGIHAARKRRVDVDCVDPSELLMQNNKRRKQQEDFPRNSSEEAINHGAVAEQSNLPEDQHTLTSKNKSNVPEGLHTLTSNNHTQGGNEEASILIVDKIIKISEVTCEMTDADNFINQEKIDGSQNSVAESVQDIVKVGGTNDHSTPAHTDDVVLPYISEIDGMVQEKQMGNVKDLTECGQAQNEMGEHKLECELVQSDNSKKNKELIAYRTRSKQKK

SEQ ID NO: 149 - protein, 1150 aa, Citrus clementina
MASPSSGRLSITPSSRVLQSPLSDESIWKRLKEAGLDEESIKRRDKAALIAYIAKLETEIFEHQHHMGLLILEKKELASKYEQIKASAEAAELLQKHDQASHLSAIAEARKREESLKKTLGVEKECIASLEKAVHEIRAESAETKVAADSKFAEARCMVENAQKKFAEAEAKLHASESLQAEANRYHRSAERKLQDVVAREDDLSRRIASFKADCEEKEREIIRERQSLSDRKKILQQEHERLLDAQTLLNEREDHILSKLQELSRKEKELEASRANVEEKFKALNEEKSNLDLTLVSLLKREEVYTISFPFLFLNLVLICFHVLFTGNYIKYDSSIECTQAVIEREASLQKKEQKLLVSQETLASKESNEIQKIIANHESALRVKQSEFEAELAIKYKLAEDEIEKKRRAWELRDLDLGQREESLLEREHDLEVQSRALVDKEKDLVERSHLLEEKENKLIAFEKEADLKKSLLQKEKEEVNIIKSDLQKSLSSLDEKKKQVNCAKDKLEAMKSEAGELSVLEIKLKEELDVVRAQKLELMVETDKLQLEKAKFEAEWEMIDEKREELRKEAESVAVERVVVSKSLKDERDSLRQERDAMRDQHKRDVDSLNREREEFMNKMVHEHSEWFTKIQQERADFLLGIEMQKRDLENCIEKRREELESSFREREKAFEEEKMRELQQISSLKEKAEKELEQVTLEIKRLDLERMEINMDRQRRDREWAELNNSIEELKVQRQKLEEQRQLLHADREEIQAESERLKKLEDLKIAVDYMAVSEMQRSRLEHSQKKISAKRHLNQQTSLAHADLGSDQKFDVTNNGDRFNTPSVQKTASASPPSLARFSWIKRFADLVFKHSGENSIENDEEKSPTSDHEDASLTINSRKRQPVRYSFGEPKVILEVPSENEVVKRTVDLESENNQNAAQKCKQSVSEDGIHAARKRRVDVDCVDPSELLMQNNKRRKQQEDFPRNSSEEAINHGAVAEQSNLPEDQHTLTSKNKSNVPEGLHTLTSNNHTQGGNEEASILIVDKIIKISEVTCEMPDADNFINQEKIDGSQNSVAESVQDIVKVGGTNDHSTPAHTDDVVLPYVSEIDGMVQEKQMGNVKDLTECGQAQNEIGEHKLECELVQSDNSKKNKELIAYRTRSKQKK

SEQ ID NO: 150 - protein, 1118 aa, Citrus sinensis
MASPSSGRLAITPSSRVLQSPLSDESIWKRLKEAGLDEVSIKRRDKAALIAYIAKLETECYILKIFEHQHHMGLLILEKKELASKYEQIKASAEAAELLQKHDRASHLSAIAEARKREESLKKTLGVEKECIASLEKAVHEIRAESAETKVAADSKFAEARCMVENAQKKFAEAEAKLHAAESLQAEANRYHRSAERKLQEVVAREDDLSRRIASFKADCEEKEREIIRERQSLSDRKKILQQEHERLLDAQTLLNEREDHILSKLQELSRKEKELEASRANVEEKFKALNEEKSNLDLTLVSLLKREEAVIEREASLQKKEQKLLVSQETLASKESNEIQKIIANHESALRVKQSEFEAELAIKYKLAEDEIEKKRRAWELRDLDLGQREESLLEREHDLEVQSRALVDKEKDLVERSHLLEEKENKLIAFEKEADLKKSLLQKEKEEVNIIKSDLQKSLSSLDEKKKQVNCAKDKLEAMKSEAGELSVLEIKLKEELDVVRAQKLELMVETDKLQLEKAKFEAEWEMIDEKREELRKEAERVAVERVVVSKSLKDERDSLRQERDAMRDQHKRDVDSLNREREEFMNKMVHEHSEWFTKIQQERADFLLGIEMQKRDLENCIEKRREELESSFREREKAFEEEKMREFQQISSLKEKAEKELEQVTLEIKRLDLERMEINMDRQRRDREWAELNNSIEELMVQRQKLEEQRQLLHADREEIQAESERLKKLEDLKIAVDYMAVSEMQRSRLEHSQKKISAKRHLNQQTSLAHADLGSDQKFDVTNNGDRFNTPSVQKTASASPPSLARFSWIKRFADLVFKHSGENSVENDEEKSPTSDHEDASLTINSRKRQPVRYSFGEPKVILEVPSENEVVKRTVDLESENNQNAAQKCKQSVSEDGIHAARKRRVDVDCVDPSELLMQNNKRRKQQEDFPRNSSEEAINHGAVAEQSNLPEDQHTLTSKNKSNVPEGLHTLTSNNHTQGGNEEASILIVDKIIKISEVTCEMTDADNFINQEKIDGSQNSVAESVQDIVKVGGTNDHSTPAHTDDVVLPYISEIDGMVQEKQMGNVKDLTECGQAQNEMGEHKLECELVQSDNSKKNKELIAYRTRSKQKK

SEQ ID NO: 151 - protein, 1075 aa, Citrus sinensis
MASPSSGRLAITPSSRVLQSPLSDESIWKRLKEAGLDEVSIKRRDKAALIAYIAKLETEIFEHQHHMGLLILEKKELASKYEQIKASAEAAELLQKHDRASHLSAIAEARKREESLKKTLGVEKECIASLEKAVHEIRAESAETKVAADSKFAEARCMVENAQKKFAEAEAKLHAAESLQAEANRYHRSAERKLQEVVAREDDLSRRIASFKADCEEKEREIIRERQSLSDRKKILQQEHERLLDAQTLLNEREDHILSKLQELSRKEKELEASRANVEEKFKALNEEKSNLDLTLVSLLKREEAVIEREASLQKKEQKLLVSQETLASKESNEIQKIIANHESALRVKQSEFEAELAIKYKLAEDEIEKKRRAWELRDLDLGQREESLLEREHDLEVQSRALVDKEKDLVERSHLLEEKENKLIAFEKEADLKKSLLQKEKEEVNIIKSDLQKSLSSLDEKKKQVNCAKDKLEAMKSEAGELSVLEIKLKEELDVVRAQKLELMVETDKLQLEKAKFEAEWEMIDEKREELRKEAERVAVERVVVSKSLKDERDSLRQERDAMRDQHKRDVDSLNREREEFMNKMVHEHSEWFTKIQQERADFLLGIEMQKRDLENCIEKRREELESSFREREKAFEEEKMREFQQISSLKEKAEKELEQVTLEIKRLDLERMEINMDRQRRDREWAELNNSIEELMVQRQKLEEQRQLLHADREEIQAESERLKKLEDLKIAVDYMAVSEMQRSRLEHSQKKISAKRHLNQQTSLAHADLGSDQKFDVTNNGDRFNTPSVQKTASASPPSLARFSWIKRFADLVFKHSGENSVENDEEKSPTSDHEDASLTINSRKRQPVRYSFGEPKVILEVPSENEVVKRTVDLESENNQNAAQKCKQSVSEDGIHAARKRRVDVDCVDPSELLMQNNKRRKQQEDFPRNSSEEAINHGAVAEQSNLPEDQHTLTSKNKSNVPEGLHTLTSNNHTQGGNEEASILIVDKIIKISEVTCEMTDADNFINQEKIDGSQNSVAESVQDIVKVGGTNDHSTPAHTDDVVLPYISEIDGMVQEKQMGNVKDLTECE

SEQ ID NO: 152 - protein, 1112 aa, Citrus sinensis
MASPSSGRLAITPSSRVLQSPLSDESIWKRLKEAGLDEVSIKRRDKAALIAYIAKLETEIFEHQHHMGLLILEKKELASKYEQIKASAEAAELLQKHDRASHLSAIAEARKREESLKKTLGVEKECIASLEKAVHEIRAESAETKVAADSKFAEARCMVENAQKKFAEAEAKLHAAESLQAEANRYHRSAERKLQEVVAREDDLSRRIASFKADCEEKEREIIRERQSLSDRKKILQQEHERLLDAQTLLNEREDHILSKLQELSRKEKELEASRANVEEKFKALNEEKSNLDLTLVSLLKREEAVIEREASLQKKEQKLLVSQETLASKESNEIQKIIANHESALRVKQSEFEAELAIKYKLAEDEIEKKRRAWELRDLDLSQREESLLEREHDLEVQSRALVDKEKDLVERSHLLEEKENKLIAFEKEADLKKSLLQKEKEEVNIIKSDLQKSLSSLDEKKKQVNCAKDKLEAMKSEAGELSVLEIKLKEELDVVRAQKLELMVETDKLQLEKAKFEAEWEMIDEKREELRKEAERVAVERVVVSKSLKDERDSLRQERDAMRDQHKRDVDSLNREREEFMNKMVHEHSEWFTKIQQERADFLLGIEMQKRDLENCIEKRREELESSFREREKAFEEEKMREFQQISSLKEKAEKELEQVTLEIKRLDLERMEINMDRQRRDREWAELNNSIEELMVQRQKLEEQRQLLHADREEIQAESERLKKLEDLKIAVDYMAVSEMQRSRLEHSQKKISAKRHLNQQTSLAHADFGSDQKFDVTNNGDRFNTPVQKTASASPPSLARFSWIKRFADLVFKHSGENSVENDEEKSPTSDHEDASLTINSRKRQPVRYSFGEPKVILEVPSENEVVKRTVDLESENNQNAAQKCKQSVSEDGIHAARKRRVDVDCVDPSELLMQNNKRRKQQEDFPRDSSEEAINHGAVAEQSNLPEDQHTLTSKNKSNVPEGLHTLTSNNHTQGGNEEASILIVDKIIKISEVTCEMTDADNFINQEKIDGSQNSVAESVQDIVKVGGTNDHSTPAHTDDVVLPYISEIDGMVQEKQMGNVKDLTECGQAQNEMGEHKLECELVQSDNSKKNKELIAYRTRSKQKK

SEQ ID NO: 153 - protein, 1106 aa, Citrus sinensis
MASPSSGRLAITPSSRVLQSPLSDESIWKRLKEAGLDEVSIKRRDKAALIAYIAKLETEIFEHQHHMGLLILEKKELASKYEQIKASAEAAELLQKHDRASHLSAIAEARKREESLKKTLGVEKECIASLEKAVHEIRAESAETKVAADSKFAEARCMVENAQKKFAEAEAKLHAAESLQAEANRYHRSAERKLQEVVAREDDLSRRIASFKADCEEKEREIIRERQSLSDRKKILQQEHERLLDAQTLLNEREDHILSKLQELSRKEKELEASRANVEEKFKALNEEKSNLDLTLVSLLKREEAVIEREASLQKKEQKLLVSQETLASKESNEIQKIIANHESALRVKQSEFEAELAIKYKLAEDEIEKKRRAWELRDLDLGQREESLLEREHDLEVQSRALVDKEKDLVERSHLLEEKENKLIAFEKEADLKKSLLQKEKEEVNIIKSDLQKSLSSLDEKKKQVNCAKDKLEAMKSEAGELSVLEIKLKEELDVVRAQKLELMVETDKLQLEKAKFEAEWEMIDEKREELRKEAERVAVERVVVSKSLKDERDSLRQERDAMRDQHKRDVDSLNREREEFMNKMVHEHSEWFTKIQQERADFLLGIEMQKRDLENCIEKRREELESSFREREKAFEEEKMREFQQISSLKEKAEKELEQVTLEIKRLDLERMEINMDRQRRDREWAELNNSIEELMVQRQLLHADREEIQAESERLKKLEDLKIAVDYMAVSEMQRSRLEHSQKKISAKRHLNQQTSLAHADLGSDQKFDVTNNGDRFNTPSVQKTASASPPSLARFSWIKRFADLVFKHSGENSVENDEEKSPTSDHEDASLTINSRKRQPVRYSFGEPKVILEVPSENEVVKRTVDLESENNQNAAQKCKQSVSEDGIHAARKRRVDVDCVDPSELLMQNNKRRKQQEDFPRNSSEEAINHGAVAEQSNLPEDQHTLTSKNKSNVPEGLHTLTSNNHTQGGNEEASILIVDKIIKISEVTCEMTDADNFINQEKIDGSQNSVAESVQDIVKVGGTNDHSTPAHTDDVVLPYISEIDGMVQEKQMGNVKDLTECGQAQNEMGEHKLECELVQSDNSKKNKELIAYRTRSKQKK

SEQ ID NO: 154 - protein, 1238 aa, Citrus unshiu
MASPSSGRLSITPSSRVLQSPLSDESIWKRLKEAGLDEESIKRRDKAALIAYIAKLETECYILKIFEHQHHMGLLILEKKELASKYEQIKASAEAAELLQKHDQASHLSAIAEARKREESLKKTLGVEKECIASLEKAVHEIRAESAETKVAADSKFAEARCMVENAQKKFAEAEAKLHASESLQAEANRYHRSAERKLQEVVAREDDLSRRIASFKAHCEEKEREIIRERQSLSDRKKILQQEHERLLDAQTLLNEREDHILSKLQELSRKEKELEASRANVEEKFKALNEEKSNLDLTLVSLLKREEAVIEREASLQKKEQKLLVSQETLASKESNEIQKIIANHESALRVKQSEFEAELAIKYKLAEDEIEKKRRAWELRDLDLGQREESLLEREHDLEVQSRALVDREKDLVERSHLLEEKENKLIAFEKEADLKKSLLQKEKEEVNIIKSDLQKSLSSLDEKKKQVNCAKDKLEAMKSEAGELSVLEIKLKEELDVVRAQKLELMVETDKLQLEKAKFEAEWEMIDEKREELRKEAERVAVERVVVSKSLKDERDSLRQERDAMRDQHKRDVDSLNREREEFMNKMVHEHSEWFTKIQQERADFLLGIEMQKRDLENCIEKRREELESSFREREKGFEEEKMREFQQISSLKEKAEKELEQVTLEIKRLDLERMEINMDRQRRDREWAELNNSIEELKVQRQKLEEQRQLLHADREEIQAESERLKKLEDLKIAVDYMAVSEMQRSRLEHSQKKISAKRHLNQQTSLAHADFGSDQKFDVTNNGDRFNTPVQKTASASPPSLARFSWIKRFADLVFKHSGENSVENDEEKSPTSDHEDASLTINSRKRQPVRYSFGEPKVILEVPSENEVVKRTVDLESENNQNAAQKCKQSVSEDGIHAARKRRVDVDCVDPSELPMQNNKRRKQQEDFPRDSSEEAINHGAVAEQSNLPEDQHTLTSKNKSNVPEGLHTLTSNNHTQGGNEEASILIVDKIIKISEVTCEMPDADNFINQEKIDGSQNSVAESVQDIVKVGGTNDHSTPAHTDDVVLPYVSEIDGMVQEKQMGNVKDLTECGQAQYAGLFVTSLGGDCLKSMYADPGTFDLFFEVNVVDPLGGDGKTALFGGGGEANGKCEGDAYNHYVREGDKDRLGYFAERPAITCAAAALPYLLLVECWVPGIFLYLLSPCVDSCSLFLHDLLNEMGEHKLECELVQSDNSKKNKELIAYRTRSKQKK

SEQ ID NO: 155 - protein, 1150 aa, Citrus sinensis
MASPSSGRLAITPSSRVLQSPLSDESIWKRLKEAGLDEVSIKRRDKAALIAYIAKLETEIFEHQHHMGLLILEKKELASKYEQIKASAEAAELLQKHDRASHLSAIAEARKREESLKKTLGVEKECIASLEKAVHEIRAESAETKVAADSKFAEARCMVENAQKKFAEAEAKLHAAESLQAEANRYHRSAERKLQEVVAREDDLSRRIASFKADCEEKEREIIRERQSLSDRKKILQQEHERLLDAQTLLNEREDHILSKLQELSRKEKELEASRANVEEKFKALNEEKSNLDLTLVSLLKREEVYTISFPFLFLNLVLICFHVLFTGNYIKYDSSIECTQAVIEREASLQKKEQKLLVSQETLASKESNEIQKIIANHESALRVKQSEFEAELAIKYKLAEDEIEKKRRAWELRDLDLGQREESLLEREHDLEVQSRALVDKEKDLVERSHLLEEKENKLIAFEKEADLKKSLLQKEKEEVNIIKSDLQKSLSSLDEKKKQVNCAKDKLEAMKSEAGELSVLEIKLKEELDVVRAQKLELMVETDKLQLEKAKFEAEWEMIDEKREELRKEAERVAVERVVVSKSLKDERDSLRQERDAMRDQHKRDVDSLNREREEFMNKMVHEHSEWFTKIQQERADFLLGIEMQKRDLENCIEKRREELESSFREREKAFEEEKMREFQQISSLKEKAEKELEQVTLEIKRLDLERMEINMDRQRRDREWAELNNSIEELMVQRQKLEEQRQLLHADREEIQAESERLKKLEDLKIAVDYMAVSEMQRSRLEHSQKKISAKRHLNQQTSLAHADLGSDQKFDVTNNGDRFNTPSVQKTASASPPSLARFSWIKRFADLVFKHSGENSVENDEEKSPTSDHEDASLTINSRKRQPVRYSFGEPKVILEVPSENEVVKRTVDLESENNQNAAQKCKQSVSEDGIHAARKRRVDVDCVDPSELLMQNNKRRKQQEDFPRNSSEEAINHGAVAEQSNLPEDQHTLTSKNKSNVPEGLHTLTSNNHTQGGNEEASILIVDKIIKISEVTCEMTDADNFINQEKIDGSQNSVAESVQDIVKVGGTNDHSTPAHTDDVVLPYISEIDGMVQEKQMGNVKDLTECGQAQNEMGEHKLECELVQSDNSKKNKELIAYRTRSKQKK

SEQ ID NO: 156 - protein, 1249 aa, Citrus unshiu
MASPSSGRLSITPSSRVLQSPLSDESIWKRLKEAGLDEESIKRRDKAALIAYIAKLETECYILKIFEHQHHMGLLILEKKELASKYEQIKASAEAAELLQKHDQASHLSAIAEARKREESLKKTLGVEKECIASVRYHQDHCLVELEKAVHEIRAESAETKVAADSKFAEARCMVENAQKKFAEAEAKLHASESLQAEANRYHRSAERKLQEVVAREDDLSRRIASFKAHCEEKEREIIRERQSLSDRKKILQQEHERLLDAQTLLNEREDHILSKLQELSRKEKELEASRANVEEKFKALNEEKSNLDLTLVSLLKREEAVIEREASLQKKEQKLLVSQETLASKESNEIQKIIANHESALRVKQSEFEAELAIKYKLAEDEIEKKRRAWELRDLDLGQREESLLEREHDLEVQSRALVDREKDLVERSHLLEEKENKLIAFEKEADLKKSLLQKEKEEVNIIKSDLQKSLSSLDEKKKQVNCAKDKLEAMKSEAGELSVLEIKLKEELDVVRAQKLELMVETDKLQLEKAKFEAEWEMIDEKREELRKEAERVAVERVVVSKSLKDERDSLRQERDAMRDQHKRDVDSLNREREEFMNKMVHEHSEWFTKIQQERADFLLGIEMQKRDLENCIEKRREELESSFREREKGFEEEKMREFQQISSLKEKAEKELEQVTLEIKRLDLERMEINMDRQRRDREWAELNNSIEELKVQRQKLEEQRQLLHADREEIQAESERLKKLEDLKIAVDYMAVSEMQRSRLEHSQKKISAKRHLNQQTSLAHADFGSDQKFDVTNNGDRFNTPVQKTASASPPSLARFSWIKRFADLVFKHSGENSVENDEEKSPTSDHEDASLTINSRKRQPVRYSFGEPKVILEVPSENEVVKRTVDLESENNQNAAQKCKQSVSEDGIHAARKRRVDVDCVDPSELPMQNNKRRKQQEDFPRDSSEEAINHGAVAEQSNLPEDQHTLTSKNKSNVPEGLHTLTSNNHTQGGNEEASILIVDKIIKISEVTCEMPDADNFINQEKIDGSQNSVAESVQDIVKVGGTNDHSTPAHTDDVVLPYVSEIDGMVQEKQMGNVKDLTECGQAQYAGLFVTSLGGDCLKSMYADPGTFDLFFEVNVVDPLGGDGKTALFGGGGEANGKCEGDAYNHYVREGDKDRLGYFAERPAITCAAAALPYLLLVECWVPGIFLYLLSPCVDSCSLFLHDLLNEMGEHKLECELVQSDNSKKNKELIAYRTRSKQKK

SEQ ID NO: 157 - protein, 1149 aa, Citrus sinensis
MASPSSGRLAITPSSRVLQSPLSDESIWKRLKEAGLDEVSIKRRDKAALIAYIAKLETEIFEHQHHMGLLILEKKELASKYEQIKASAEAAELLQKHDRASHLSAIAEARKREESLKKTLGVEKECIASLEKAVHEIRAESAETKVAADSKFAEARCMVENAQKKFAEAEAKLHAAESLQAEANRYHRSAERKLQEVVAREDDLSRRIASFKADCEEKEREIIRERQSLSDRKKILQQEHERLLDAQTLLNEREDHILSKLQELSRKEKELEASRANVEEKFKALNEEKSNLDLTLVSLLKREEVYMISFPFLFLNLVLICFHVFFTGNYIKYDSSIECTQAVIEREASLQKKEQKLLVSQETLASKESNEIQKIIANHESALRVKQSEFEAELAIKYKLAEDEIEKKRRAWELRDLDLSQREESLLEREHDLEVQSRALVDKEKDLVERSHLLEEKENKLIAFEKEADLKKSLLQKEKEEVNIIKSDLQKSLSSLDEKKKQVNCAKDKLEAMKSEAGELSVLEIKLKEELDVVRAQKLELMVETDKLQLEKAKFEAEWEMIDEKREELRKEAERVAVERVVVSKSLKDERDSLRQERDAMRDQHKRDVDSLNREREEFMNKMVHEHSEWFTKIQQERADFLLGIEMQKRDLENCIEKRREELESSFREREKAFEEEKMREFQQISSLKEKAEKELEQVTLEIKRLDLERMEINMDRQRRDREWAELNNSIEELMVQRQKLEEQRQLLHADREEIQAESERLKKLEDLKIAVDYMAVSEMQRSRLEHSQKKISAKRHLNQQTSLAHADFGSDQKFDVTNNGDRFNTPVQKTASASPPSLARFSWIKRFADLVFKHSGENSVENDEEKSPTSDHEDASLTINSRKRQPVRYSFGEPKVILEVPSENEVVKRTVDLESENNQNAAQKCKQSVSEDGIHAARKRRVDVDCVDPSELLMQNNKRRKQQEDFPRDSSEEAINHGAVAEQSNLPEDQHTLTSKNKSNVPEGLHTLTSNNHTQGGNEEASILIVDKIIKISEVTCEMTDADNFINQEKIDGSQNSVAESVQDIVKVGGTNDHSTPAHTDDVVLPYISEIDGMVQEKQMGNVKDLTECGQAQNEMGEHKLECELVQSDNSKKNKELIAYRTRSKQKK

SEQ ID NO: 158 - protein, 1275 aa, Citrus unshiu
MASPSSGRLSITPSSRVLQSPLSDESIWKRLKEAGLDEESIKRRDKAALIAYIAKLETECYILKIFEHQHHMGLLILEKKELASKYEQIKASAEAAELLQKHDQASHLSAIAEARKREESLKKTLGVEKECIASLEKAVHEIRAESAETKVAADSKFAEARCMVENAQKKFAEAEAKLHASESLQAEANRYHRSAERKLQEVVAREDDLSRRIASFKAHCEEKEREIIRERQSLSDRKKILQQEHERLLDAQTLLNEREDHILSKLQELSRKEKELEASRANVEEKFKALNEEKSNLDLTLVSLLKREEVYMISFPFLFLNLVLICFHVFFTGNYIKYDSSIECTQAVIEREASLQKKEQKLLVSQETLASKESNEIQKIIANHESALRVKQSEFEAELAIKYKLAEDEIEKKRRAWELRDLDLGQREESLLEREHDLEVQSRALVDREKDLVERSHLLEEKENKLIAFEKEADLKKSLLQKEKEEVNIIKSDLQKSLSSLDEKKKQVNCAKDKLEAMKSEAGELSVLEIKLKEELDVVRAQKLELMVETDKLQLEKAKFEAEWEMIDEKREELRKEAERVAVERVVVSKSLKDERDSLRQERDAMRDQHKRDVDSLNREREEFMNKMVHEHSEWFTKIQQERADFLLGIEMQKRDLENCIEKRREELESSFREREKGFEEEKMREFQQISSLKEKAEKELEQVTLEIKRLDLERMEINMDRQRRDREWAELNNSIEELKVQRQKLEEQRQLLHADREEIQAESERLKKLEDLKIAVDYMAVSEMQRSRLEHSQKKISAKRHLNQQTSLAHADFGSDQKFDVTNNGDRFNTPVQKTASASPPSLARFSWIKRFADLVFKHSGENSVENDEEKSPTSDHEDASLTINSRKRQPVRYSFGEPKVILEVPSENEVVKRTVDLESENNQNAAQKCKQSVSEDGIHAARKRRVDVDCVDPSELPMQNNKRRKQQEDFPRDSSEEAINHGAVAEQSNLPEDQHTLTSKNKSNVPEGLHTLTSNNHTQGGNEEASILIVDKIIKISEVTCEMPDADNFINQEKIDGSQNSVAESVQDIVKVGGTNDHSTPAHTDDVVLPYVSEIDGMVQEKQMGNVKDLTECGQAQYAGLFVTSLGGDCLKSMYADPGTFDLFFEVNVVDPLGGDGKTALFGGGGEANGKCEGDAYNHYVREGDKDRLGYFAERPAITCAAAALPYLLLVECWVPGIFLYLLSPCVDSCSLFLHDLLNEMGEHKLECELVQSDNSKKNKELIAYRTRSKQKK

SEQ ID NO: 159 - protein, 1081 aa, Citrus sinensis
MASPSSGRLAITPSSRVLQSPLSDESIWKRLKEAGLDEVSIKRRDKAALIAYIAKLETEIFEHQHHMGLLILEKKELASKYEQIKASAEAAELLQKHDRASHLSAIAEARKREESLKKTLGVEKECIASLEKAVHEIRAESAETKVAADSKFAEARCMVENAQKKFAEAEAKLHAAESLQAEANRYHRSAERKLQEVVAREDDLSRRIASFKADCEEKEREIIRERQSLSDRKKILQQEHERLLDAQTLLNEREDHILSKLQELSRKEKELEASRANVEEKFKALNEEKSNLDLTLVSLLKREEAVIEREASLQKKEQKLLVSQETLASKESNEIQKIIANHESALRVKQSEFEAELAIKYKLAEDEIEKKRRAWELRDLDLGQREESLLEREHDLEVQSRALVDKEKDLVERSHLLEEKENKLIAFEKEADLKKSLLQKEKEEVNIIKSDLQKSLSSLDEKKKQVNCAKDKLEAMKSEAGELSVLEIKLKEELDVVRAQKLELMVETDKLQLEKAKFEAEWEMIDEKREELRKEAERVAVERVVVSKSLKDERDSLRQERDAMRDQHKRDVDSLNREREEFMNKMVHEHSEWFTKIQQERADFLLGIEMQKRDLENCIEKRREELESSFREREKAFEEEKMREFQQISSLKEKAEKELEQVTLEIKRLDLERMEINMDRQRRDREWAELNNSIEELMVQRQKLEEQRQLLHADREEIQAESERLKKLEDLKIAVDYMAVSEMQRSRLEHSQKKISAKRHLNQQTSLAHADLGSDQKFDVTNNGDRFNTPSVQKTASASPPSLARFSWIKRFADLVFKHSGENSVENDEEKSPTSDHEDASLTINSRKRQPVRYSFGEPKVILEVPSENEVVKRTVDLESENNQNAAQKCKQSVSEDGIHAARKRRVDVDCVDPSELLMQNNKRRKQQEDFPRNSSEEAINHGAVAEQSNLPEDQHTLTSKNKSNVPEGLHTLTSNNHTQGEKIDGSQNSVAESVQDIVKVGGTNDHSTPAHTDDVVLPYISEIDGMVQEKQMGNVKDLTECGQAQNEMGEHKLECELVQSDNSKKNKELIAYRTRSKQKK

SEQ ID NO: 160 - protein, 1078 aa, Citrus sinensis
MASPSSGRLAITPSSRVLQSPLSDESIWKRLKEAGLDEVSIKRRDKAALIAYIAKLETEIFEHQHHMGLLILEKKELASKYEQIKASAEAAELLQKHDRASHLSAIAEARKREESLKKTLGVEKECIASLEKAVHEIRAESAETKVAADSKFAEARCMVENAQKKFAEAEAKLHAAESLQAEANRYHRSAERKLQEVVAREDDLSRRIASFKADCEEKEREIIRERQSLSDRKKILQQEHERLLDAQTLLNEREDHILSKLQELSRKEKELEASRANVEEKFKALNEEKSNLDLTLVSLLKREEAVIEREASLQKKEQKLLVSQETLASKESNEIQKIIANHESALRVKQSEFEAELAIKYKLAEDEIEKKRRAWELRDLDLGQREESLLEREHDLEVQSRALVDKEKDLVERSHLLEEKENKLIAFEKEADLKKSLLQKEKEEVNIIKSDLQKSLSSLDEKKKQVNCAKDKLEAMKSEAGELSVLEIKLKEELDVVRAQKLELMVETDKLQLEKAKFEAEWEMIDEKREELRKEAERVAVERVVVSKSLKDERDSLRQERDAMRDQHKRDVDSLNREREEFMNKMVHEHSEWFTKIQQERADFLLGIEMQKRDLENCIEKRREELESSFREREKAFEEEKMREFQQISSLKEKAEKELEQVTLEIKRLDLERMEINMDRQRRDREWAELNNSIEELMVQRQKLEEQRQLLHADREEIQAESERLKKLEDLKIAVDYMAVSEMQRSRLEHSQKKISAKRHLNQQTSLAHADLGSDQKFDVTNNGDRFNTPSVQKTASASPPSLARFSWIKRFADLVFKHSGENSVENDEEKSPTSDHEDASLTINSRKRQPVRYSFGEPKVILEVPSENEVVKRTVDLESENNQNAAQKCKQSVSEDGIHAARKRRVDVDCVDPSELLMQNNKRRKQQEDFPRNSSEEAINHGAVAEQSNLPEDQHTLTSKNKSNVPEGLHTLTSNNHTQGDGSQNSVAESVQDIVKVGGTNDHSTPAHTDDVVLPYISEIDGMVQEKQMGNVKDLTECGQAQNEMGEHKLECELVQSDNSKKNKELIAYRTRSKQKK

SEQ ID NO: 161 - protein, 1047 aa, Citrus sinensis
MGLLILEKKELASKYEQIKASAEAAELLQKHDRASHLSAIAEARKREESLKKTLGVEKECIASLEKAVHEIRAESAETKVAADSKFAEARCMVENAQKKFAEAEAKLHAAESLQAEANRYHRSAERKLQEVVAREDDLSRRIASFKADCEEKEREIIRERQSLSDRKKILQQEHERLLDAQTLLNEREDHILSKLQELSRKEKELEASRANVEEKFKALNEEKSNLDLTLVSLLKREEAVIEREASLQKKEQKLLVSQETLASKESNEIQKIIANHESALRVKQSEFEAELAIKYKLAEDEIEKKRRAWELRDLDLGQREESLLEREHDLEVQSRALVDKEKDLVERSHLLEEKENKLIAFEKEADLKKSLLQKEKEEVNIIKSDLQKSLSSLDEKKKQVNCAKDKLEAMKSEAGELSVLEIKLKEELDVVRAQKLELMVETDKLQLEKAKFEAEWEMIDEKREELRKEAERVAVERVVVSKSLKDERDSLRQERDAMRDQHKRDVDSLNREREEFMNKMVHEHSEWFTKIQQERADFLLGIEMQKRDLENCIEKRREELESSFREREKAFEEEKMREFQQISSLKEKAEKELEQVTLEIKRLDLERMEINMDRQRRDREWAELNNSIEELMVQRQKLEEQRQLLHADREEIQAESERLKKLEDLKIAVDYMAVSEMQRSRLEHSQKKISAKRHLNQQTSLAHADLGSDQKFDVTNNGDRFNTPSVQKTASASPPSLARFSWIKRFADLVFKHSGENSVENDEEKSPTSDHEDASLTINSRKRQPVRYSFGEPKVILEVPSENEVVKRTVDLESENNQNAAQKCKQSVSEDGIHAARKRRVDVDCVDPSELLMQNNKRRKQQEDFPRNSSEEAINHGAVAEQSNLPEDQHTLTSKNKSNVPEGLHTLTSNNHTQGGNEEASILIVDKIIKISEVTCEMTDADNFINQEKIDGSQNSVAESVQDIVKVGGTNDHSTPAHTDDVVLPYISEIDGMVQEKQMGNVKDLTECGQAQNEMGEHKLECELVQSDNSKKNKELIAYRTRSKQKK

SEQ ID NO: 162 - protein, 944 aa, Citrus sinensis
MASPSSGRLAITPSSRVLQSPLSDESIWKRLKEAGLDEVSIKRRDKAALIAYIAKLETEIFEHQHHMGLLILEKKELASKYEQIKASAEAAELLQKHDRASHLSAIAEARKREESLKKTLGVEKECIASLEKAVHEIRAESAETKVAADSKFAEARCMVENAQKKFAEAEAKLHAAESLQAEANRYHRSAERKLQEVVAREDDLSRRIASFKADCEEKEREIIRERQSLSDRKKILQQEHERLLDAQTLLNEREDHILSKLQELSRKEKELEASRANVEEKFKALNEEKSNLDLTLVSLLKREEAVIEREASLQKKEQKLLVSQETLASKESNEIQKIIANHESALRVKQSEFEAELAIKYKLAEDEIEKKRRAWELRDLDLGQREESLLEREHDLEVQSRALVDKEKDLVERSHLLEEKENKLIAFEKEADLKKSLLQKEKEEVNIIKSDLQKSLSSLDEKKKQVNCAKDKLEAMKSEAGELSVLEIKLKEELDVVRAQKLELMVETDKLQLEKAKFEAEWEMIDEKREELRKEAERVAVERVVVSKSLKDERDSLRQERDAMRDQHKRDVDSLNREREEFMNKMVHEHSEWFTKIQQERADFLLGIEMQKRDLENCIEKRREELESSFREREKAFEEEKMREFQQISSLKEKAEKELEQVTLEIKRLDLERMEINMDRQRRDREWAELNNSIEELMVQRQKLEEQRQLLHADREEIQAESERLKKLEDLKIAVDYMAVSEMQRSRLEHSQKKISAKRHLNQQTSLAHADLGSDQKFDVTNNGDRFNTPSVQKTASASPPSLARFSWIKRFADLVFKHSGENSVENDEEKSPTSDHEDASLTINSRKRQPVRYSFGEPKVILEVPSENEVVKRTVDLESENNQNAAQKCKQSVSEDGIHAARKRRVDVDCVDPSELLMQNNKRRKQQEDFPRNSSEEAINHGC

SEQ ID NO: 163 - protein, 981 aa, Citrus clementina
MASPSSGRLSITPSSRVLQSPLSDESIWKRLKEAGLDEESIKRRDKAALIAYIAKLETEIFEHQHHMGLLILEKKELASKYEQIKASAEAAELLQKHDQASHLSAIAEARKREESLKKTLGVEKECIASLEKAVHEIRAESAETKVAADSKFAEARCMVENAQKKFAEAEAKLHASESLQAEANRYHRSAERKLQDVVAREDDLSRRIASFKADCEEKEREIIRERQSLSDRKKILQQEHERLLDAQTLLNEREDHILSKLQELSRKEKELEASRANVEEKFKALNEEKSNLDLTLVSLLKREEVYTISFPFLFLNLVLICFHVLFTGNYIKYDSSIECTQAVIEREASLQKKEQKLLVSQETLASKESNEIQKIIANHESALRVKQSEFEAELAIKYKLAEDEIEKKRRAWELRDLDLGQREESLLEREHDLEVQSRALVDKEKDLVERSHLLEEKENKLIAFEKEADLKKSLLQKEKEEVNIIKSDLQKSLSSLDEKKKQVNCAKDKLEAMKSEAGELSVLEIKLKEELDVVRAQKLELMVETDKLQLEKAKFEAEWEMIDEKREELRKEAESVAVERVVVSKSLKDERDSLRQERDAMRDQHKRDVDSLNREREEFMNKMVHEHSEWFTKIQQERADFLLGIEMQKRDLENCIEKRREELESSFREREKAFEEEKMRELQQISSLKEKAEKELEQVTLEIKRLDLERMEINMDRQRRDREWAELNNSIEELKVQRQKLEEQRQLLHADREEIQAESERLKKLEDLKIAVDYMAVSEMQRSRLEHSQKKISAKRHLNQQTSLAHADLGSDQKFDVTNNGDRFNTPSVQKTASASPPSLARFSWIKRFADLVFKHSGENSIENDEEKSPTSDHEDASLTINSRKRQPVRYSFGEPKVILEVPSENEVVKRTVDLESENNQNAAQKCKQSVSEDGIHAARKRRVDVDCVDPSELLMQNNKRRKQQEDFPRNSSEEAINHGC

SEQ ID NO: 164 - protein, 956 aa, Citrus sinensis
MVENAQKKFAEAEAKLHAAESLQAEANRYHRSAERKLQEVVAREDDLSRRIASFKADCEEKEREIIRERQSLSDRKKILQQEHERLLDAQTLLNEREDHILSKLQELSRKEKELEASRANVEEKFKALNEEKSNLDLTLVSLLKREEAVIEREASLQKKEQKLLVSQETLASKESNEIQKIIANHESALRVKQSEFEAELAIKYKLAEDEIEKKRRAWELRDLDLGQREESLLEREHDLEVQSRALVDKEKDLVERSHLLEEKENKLIAFEKEADLKKSLLQKEKEEVNIIKSDLQKSLSSLDEKKKQVNCAKDKLEAMKSEAGELSVLEIKLKEELDVVRAQKLELMVETDKLQLEKAKFEAEWEMIDEKREELRKEAERVAVERVVVSKSLKDERDSLRQERDAMRDQHKRDVDSLNREREEFMNKMVHEHSEWFTKIQQERADFLLGIEMQKRDLENCIEKRREELESSFREREKAFEEEKMREFQQISSLKEKAEKELEQVTLEIKRLDLERMEINMDRQRRDREWAELNNSIEELMVQRQKLEEQRQLLHADREEIQAESERLKKLEDLKIAVDYMAVSEMQRSRLEHSQKKISAKRHLNQQTSLAHADLGSDQKFDVTNNGDRFNTPSVQKTASASPPSLARFSWIKRFADLVFKHSGENSVENDEEKSPTSDHEDASLTINSRKRQPVRYSFGEPKVILEVPSENEVVKRTVDLESENNQNAAQKCKQSVSEDGIHAARKRRVDVDCVDPSELLMQNNKRRKQQEDFPRNSSEEAINHGAVAEQSNLPEDQHTLTSKNKSNVPEGLHTLTSNNHTQGGNEEASILIVDKIIKISEVTCEMTDADNFINQEKIDGSQNSVAESVQDIVKVGGTNDHSTPAHTDDVVLPYISEIDGMVQEKQMGNVKDLTECGQAQNEMGEHKLECELVQSDNSKKNKELIAYRTRSKQKK

SEQ ID NO: 165 - protein, 980 aa, Citrus sinensis
MASPSSGRLAITPSSRVLQSPLSDESIWKRLKEAGLDEVSIKRRDKAALIAYIAKLETEIFEHQHHMGLLILEKKELASKYEQIKASAEAAELLQKHDRASHLSAIAEARKREESLKKTLGVEKECIASLEKAVHEIRAESAETKVAADSKFAEARCMVENAQKKFAEAEAKLHAAESLQAEANRYHRSAERKLQEVVAREDDLSRRIASFKADCEEKEREIIRERQSLSDRKKILQQEHERLLDAQTLLNEREDHILSKLQELSRKEKELEASRANVEEKFKALNEEKSNLDLTLVSLLKREEVYMISFPFLFLNLVLICFHVFFTGNYIKYDSSIECTQAVIEREASLQKKEQKLLVSQETLASKESNEIQKIIANHESALRVKQSEFEAELAIKYKLAEDEIEKKRRAWELRDLDLSQREESLLEREHDLEVQSRALVDKEKDLVERSHLLEEKENKLIAFEKEADLKKSLLQKEKEEVNIIKSDLQKSLSSLDEKKKQVNCAKDKLEAMKSEAGELSVLEIKLKEELDVVRAQKLELMVETDKLQLEKAKFEAEWEMIDEKREELRKEAERVAVERVVVSKSLKDERDSLRQERDAMRDQHKRDVDSLNREREEFMNKMVHEHSEWFTKIQQERADFLLGIEMQKRDLENCIEKRREELESSFREREKAFEEEKMREFQQISSLKEKAEKELEQVTLEIKRLDLERMEINMDRQRRDREWAELNNSIEELMVQRQKLEEQRQLLHADREEIQAESERLKKLEDLKIAVDYMAVSEMQRSRLEHSQKKISAKRHLNQQTSLAHADFGSDQKFDVTNNGDRFNTPVQKTASASPPSLARFSWIKRFADLVFKHSGENSVENDEEKSPTSDHEDASLTINSRKRQPVRYSFGEPKVILEVPSENEVVKRTVDLESENNQNAAQKCKQSVSEDGIHAARKRRVDVDCVDPSELLMQNNKRRKQQEDFPRDSSEEAINHGC

SEQ ID NO: 166 - protein, 486 aa, Solanum lycopersicum
MASPGSGRLALTPVNPTPISGLGRVSKTPLTDEVIWKRLREAGFDEDSIKRRDKAALIAYIAKLETELYDHQYQMGLLILERKEWVSKNEQSKAASESAELLYKREQAARLSDTAEAKKLEANLKKALGIEKECVANIEKALHEMRAECAEAKVASENKLAEAQSMMEDAQKKYTDVEEKLRKAESLEAEASLFHRTAERKLREVESREDDLRRQTLLFKSECEAKEKEIQLERQSLSERQKTLQRSQEELLDGQALLNKREEFIFSRSQELNRHEKDLEDEKSNFENDIKSLNEEKRNLEVKLKSLSAREEGIIRREHELYEKEKELLLLQGKIQSKEIDGSKQVMVNQEATLVTKISSIERCADTLLDRTPSNKRRREDGDFISQLTENGASCPLPPTPDAPDVENLEVLPNQTHIAAEETTVYIDKIVTVHEVTEIDVRKVTEGSPGTLSGDSGRKVGNNGSLESDQNGKPEGRARRTRATRK

SEQ ID NO: 167 - protein, 937 aa, Solanum tuberosum
MASPGSGRLALTPVNPTPISGLGRVSKTPLTDEVIWKRLREAGFDEDSIKRRDKAALIAYIAKLETELYDHQYQMGLLILERKEWVSKNEQFKAASVSAELLYKREQAARLSDMAEAKKLEANLKKALGIEKECVANIEKALHEMRAECAEAKVASENKLTEAQSMMEDAQKKYADVEEKLRKAESLEAEASLFHRTAERKLREVESREDDLRRQTLLFKSDCEAKEKEIQLERQSLSERLKTLQRSQEELLDAQALLNKREEFIFSRSQELNRHEKDLEDEKSNLENDIKSLNEKKRNLEVKLKSLSAREEGIIKREHKLNEKEEELLLLQGKMQSKEIDDSKQVMVNQEATLVTKISSIEAELETKRKLVEDEIQTKRRAWELKDMDIKSREDLITDKEYDLERQSRTLAEKEKELEDKVHVIEEKERNLQAAEKEVELQRTVLQQEREGISKMRNDLEKSLKMLDEKRKCVDHEEEKVEAMKNETQELLILETRLKLEIDMIRAEKEEIEMEADRLKAEKAKFETEWEVIDEKREELQKEAERVAEEKLAISKLLKDSRDSLKAEKNAIQEEYKQNLESLSRDRETFMYEIESERAEWFNKIQKERENFLLDVEMQKKELENRIEKRREEIETDLKEKEKAFEELKKRELQDIASLRETVEKELEHVGLELNKLDAERKEINLDRERRDKEWAELNNAIEELKVQRLKLEKQRELLHADRKEILAQIEQLKKLEDVKIIPDRIATPKKLHSGLPSNELKPSAKRLLKHASVLGSGLDGNGNNGVRQDTPSIMKENGNSSSTLSTPFSWLKRCADTLLDRTPSNKRRREDGHFISQLTEYGASGTLSSSPDAPDVEHLEVLPNHTPIAAEETTVYIDKIVTVHEVTEIDVRKVTEGSLETLSGESGRKVGNNGSLQSDKNGKPEGRSRRTKATRK

SEQ ID NO: 168 - protein, 170 aa, Citrus trifoliata
MTSQFIQNPESIFDLSVKDARGHEVDLSTYKGKVLLIVNVASKCGMTNSNYIELSQLYDKYKDQGLEILAFPCNQFGEEEPGSNDQIADFVCTRFKSEFPIFEKIDVNGEHASPLYKLLKSGKWGIFGDDIQWNFAKFLVDKNGQVVDRYYPTTSPLSLEHDIKKLLGLS

SEQ ID NO: 169 - protein, 224 aa, Citrus trifoliata
MLRCYHLKRNLGGIATSLILTRHFTSNYKQTLLRPSKSNPISLVSRPCFFASRSDHTMASQSKTSVHDFTVKDAKGQDVDLSIYKGKLLLIVNVASQCGLTNSNYTELSQLYDKYKNQGLEILAFPCNQFGAQEPGDNEQIQEFACTRFKAEFPIFDKVDVNGDNAAPLYKHLKSSKGGLFGDSIKWNFSKFLVDKEGNVVERYAPTTSPLSIEKDIKKLLETA

SEQ ID NO: 170 - protein, 170 aa, Citrus clementina
MTSQFIQNPESIFDLSVKDARGHEVDLSTYKGKVLLIVNVASKCGMTNSNYIELSQLYDKYKDQGLEILAFPCNQFGEEEPGSNDQIADFVCTRFKSEFPIFEKIDVNGEHASPLYKLLKLGKWGIFGDDIQWNFAKFLVDKNGEVVDRYYPTTSPLSLERDIKKLLGLS

SEQ ID NO: 171 - protein, 125 aa, Citrus clementina
MTNSNYIELSQLYDKYKDQGLEILAFPCNQFGEEEPGSNDQIADFVCTRFKSEFPIFEKIDVNGEHASPLYKLLKLGKWGIFGDDIQWNFAKFLVDKNGEVVDRYYPTTSPLSLERDIKKLLGLS

SEQ ID NO: 172 - protein, 142 aa, Citrus unshiu
MTSQFIQNPEMPEAMSGMTNSNYIELSQLYDKYKDQGLEILAFPCNQFGEEEPGSNDQIADFVCTRFKSEFPIFEKIDVNGEHASPLYKLLKSGKWGIFGDDIQWNFAKFLVDKNGEVVDRYYPTTSPLSLERDIKKLLGLS

SEQ ID NO: 173 - protein, 170 aa, Citrus unshiu
MTSQFIQNPESIFDLSVKDARGHEVDLSTYKGKVLLIVNVASKCGMTNSNYIELSQLYDKYKDQGLEILAFPCNQFGEEEPGSNDQIADFVCTRFKSEFPIFEKIDVNGEHASPLYKLLKSGKWGIFGDDIQWNFAKFLVDKNGEVVDRYYPTTSPLSLERDIKKLLGLS

SEQ ID NO: 174 - protein, 170 aa, Citrus sinensis
MTSQFIQNPESIFDLSVKDARGHEVDLSTYKGKVLLIVNVASKCGMTNSNYIELSQLYDKYKDQGLEILAFPCNQFGEEEPGSNDQIADFVCTRFKSEFPIFEKIDVNGEHASPLYKLLKSGKWGIFGDDIQWNFAKFLVDKNGQVVDRYYPTTSLLSLEHDIKKLLGLS

SEQ ID NO: 175 - protein, 170 aa, Citrus sinensis
MFLGVLFIYLIIIIGHSQDARGHEVDLSTYKGKVLLIVNVASKCGMTNSNYIELSQLYDKYKDQGLEILAFPCNQFGEEEPGSNDQIADFVCTRFKSEFPIFEKIDVNGEHASPLYKLLKSGKWGIFGDDIQWNFAKFLVDKNGQVVDRYYPTTSLLSLEHDIKKLLGLS

SEQ ID NO: 176 - protein, 178 aa, Citrus unshiu
MTSQFIQNPESIFDLSVKDARGHEVDLSTYKGKVLLIVNVASKCGMTNSNYIELSQLYDKYKDQGLEILAFPCNQFGEEEPGSNDQIADFVCTRFKSEFPIFEKIDVNGEHASPLYKLLKSGKWGIFGDDIQWNFAKFLVDKNGEVVDRYYPTTSPLSLELHQILTSQRDIKKLLGLS

SEQ ID NO: 177 - protein, 125 aa, Citrus sinensis
MTNSNYIELSQLYDKYKDQGLEILAFPCNQFGEEEPGSNDQIADFVCTRFKSEFPIFEKIDVNGEHASPLYKLLKSGKWGIFGDDIQWNFAKFLVDKNGQVVDRYYPTTSLLSLEHDIKKLLGLS

SEQ ID NO: 178 - protein, 163 aa, Citrus sinensis
MTSQFIQNPESIFDLSVKDARGHEVDLSTYKGKVLLIVNVASKCGMTNSNYIELSQLYDKYKDQGLEILAFPCNQFGEEEPGSNDQIADFVCTRFKSEFPIFEKIDVNGEHASPLYKLLKSGKWGIFGDDIQWNFAKFLVDKNGQVVDRYYPTTSLLSLEVIL

SEQ ID NO: 179 - protein, 137 aa, Citrus clementina
MTSQFIQNPESIFDLSVKDARGHEVDLSTYKGLEILAFPCNQFGEEEPGSNDQIADFVCTRFKSEFPIFEKIDVNGEHASPLYKLLKLGKWGIFGDDIQWNFAKFLVDKNGEVVDRYYPTTSPLSLERDIKKLLGLS

SEQ ID NO: 180 - protein, 127 aa, Citrus unshiu
MTSQFIQNPESIFDLSVKDARGHEILAFPCNQFGEEEPGSNDQIADFVCTRFKSEFPIFEKIDVNGEHASPLYKLLKSGKWGIFGDDIQWNFAKFLVDKNGEVVDRYYPTTSPLSLERDIKKLLGLS

SEQ ID NO: 181 - protein, 167 aa, Citrus sinensis
MASQSKTSVHDFTVKDAKGQDVDLSIYKGKLLLIVNVASQCGLTNSNYTELSQLYDKYKNQGLEILAFPCNQFGAQEPGDNEQIQEFACTRFKAEFPIFDKVDVNGDNAAPLYKHLKSSKGGLFGDSIKWNFSKFLVDKEGNVVERYAPTTSPLSIEKDIKKLLETA

SEQ ID NO: 182 - protein, 167 aa, Citrus sinensis
MASQSKTSVHDFSVKDAKGQDVDLSIYKGKLLLIVNVASQCGLTNSNYTELSQLYDKYKNQGLEILAFPCNQFGAQEPGDNEQIQEFACTRFKAEFPIFDKVDVNGDNAAPLYKHLKSSKGGLFGDSIKWNFSKFLVDKEGNVVERYAPTTSPLSIEKDIKKLLETA

SEQ ID NO: 183 - protein, 152 aa, Citrus unshiu
DAKGQDVDLSIYKGKLLLIVNVASQCGLTNSNYTELSQLYDKYKNQGLEILAFPCNQFGAQEPGDNEQIQEFACTRFKAEFPIFDKVDVNGDNAAPLYKHLKSSKGGLFGDSIKWNFSKFLVDKEGNVVERYAPTTSPLSIEKDIKKLLETA

SEQ ID NO: 184 - protein, 223 aa, Citrus clementina
MLRCYLLKRNLGIATSHILTRHFTSNYKQTLLRPSKSNPISLVSRPCFFASRSDHTMASQSKTSVHDFTVKDAKGQDVDLSIYKGKLLLIVNVASQCGLTNSNYTELSQLYDKYKNQGLEILAFPCNQFGAQEPGDNEQIQEFACTRFKAEFPIFDKVDVNGDNAAPLYKHLKSSKGGLFGDSIKWNFSKFLVDKEGNVVERYAPTTSPLSIEKDIKKLLETA

SEQ ID NO: 185 - protein, 227 aa, Citrus sinensis
MLRCCASRYLLKRNLGIATSLILTRHFTSNCKQTLLRPSKSNPISLVSRPCFFASRSDHTMASQSKTSVHDFSVKDAKGQDVDLSIYKGKLLLIVNVASQCGLTNSNYTELSQLYDKYKNQGLEILAFPCNQFGAQEPGDNEQIQEFACTRFKAEFPIFDKVDVNGDNAAPLYKHLKSSKGGLFGDSIKWNFSKFLVDKEGNVVERYAPTTSPLSIEKDIKKLLETA

SEQ ID NO: 186 - protein, 166 aa, Citrus clementina
MISPRDSLILAQCRRQFIFYFLFFIFSFIRFIHLPDFERSGLTNSNYTELSQLYDKYKNQGLEILAFPCNQFGAQEPGDNEQIQEFACTRFKAEFPIFDKVDVNGDNAAPLYKHLKSSKGGLFGDSIKWNFSKFLVDKEGNVVERYAPTTSPLSIEKDIKKLLETA

SEQ ID NO: 187 - protein, 225 aa, Citrus sinensis
MLRCCASRYLLKRNLGIATSLILTRHFTSNCKQTLLRPSKSNPISLVSRPCFFASRSDHTMASQSKTSVHDFSVKDAKGQDVDLSIYKGKLLLIVNVASQCGLTNSNYTELSQLYDKYKNQGLEILAFPCNQFGAQEPGDNEQIQEFACTRFKAEFPIFDKVDVNGDNAAPLYKHLKSSKGGLFGDSIKWNFSKFLVDKEGNVVERYAPTTSPLSIEVVLECLCC

SEQ ID NO: 188 - protein, 170 aa, Solanum lycopersicum
MAGQPEKKPQSVYDFSLKDATGNDVDLSIFKGKVLLIVNVASKCGMTNSNYTELNQLYEKYKDQGLEILAFPCNQFGEEEPGTNDQILNFVCTRFKSDFPIFDKIEVNGENASPLYKFLKSGKWGIFGDDIQWNFAKFLVDKNGQVVDRYYPTTSPLTIERDMKKLLETI

SEQ ID NO: 189 - protein, 170 aa, Solanum tuberosum
MAGQPEKKPQSVYDFTLKDAIGNDVDLSIYKGKVLLIVNVASKCGMTNSNYTELNQLYEKYKDQDLEILAFPCNQFGEEEPGTNDQILDFVCTRFKSDFPIFDKIEVNGENASPLYKFLKSGKWGIFGDDIQWNFAKFLVDKNGQVVDRYYPTTSPLTIERDMKKLLEII

SEQ ID NO: 190 - protein, 894 aa, Citrus trifoliata
MFNPVLVNQTRSIRTILPLSKPFLHGNGNVFRQIQSSPSFKKGPKIRLGSVSSNSVKAMADTAVSNGVTAVVTVRPPINPLTAGGQVIDDVEDLFSKSLQLELVSAKDENKPTISGNAKIKGVVVKDCEVQYEAEFQVPVDFGEIGAILVANEHALEMYLKDIVLDGLPSGLVTITCESWVQPNTSKDPRIFFTNKSYLPSKTPNGLQKLRYAELVNLRGNGEGERQKADRIYDYDVYNDLGDPDKDEALKRPVLGGKQHPYPRRCRTGRPHCKTDEASEERVPSKSLINISPYVPRDEEFSAIKETTFVIRTLFGLFRSLIPNLKAEFVDTDGFPNFTEIDKLFREGVKIKDAEFWKSLLPGFVEEIKDIGEFFLKFTSPETFKRDRFFWFRDEEFARETLAGLNPCSIRLITEWPLKSSLDRKIYGPSESAITTEMIESEIKGCTTVKEALNQKKLFILDYHDLFLPHVEQVRELGDRTLYGSRTVFYLNPDGTLRPLAIELTRPPMDGKPQWKQAFTPSSDSTKSWLWKLAKAHVLAHDSGYHQLISHWLRTHCSVEPYAIAAHRQLSALHPINRLLKPHFRYTMEINSLARQSLINAGGVIESTFLPGKYSMLLSSIIYDKQWRFDHQALPQDLISRGMAVKDPSSPHGLKLTIEDYPFAQDGLDLWDIIKQWVTDYVSHYYPDPSLVESDEELQAWWTEIRTVGHGDKQDETWWPVLNSPKDLIDTITNIVWVASGLHAAVNFGQYEYAAYFPNRPTIARANMPNEDPSDDEWKIFFERPEAALLTTFPNQKQATAVISVLDVLSAHSPDEDYLGKYMEPAWGEDKIIKGAFEKFQGRLMELKGTINLRNADKNLKNRNGAGSLPYELLMPLADKSGVTGKGVPYSISI

SEQ ID NO: 191 - protein, 900 aa, Citrus trifoliata
MLKPQVHQPQSIKPLFPLSKPFLHGNYGYAFRPVPSTSSLIKGSPKLRIGSVPRNTIKAIATSTEKSVKVKAVVTVKPTVGGFLSNISLERGLDDIGDLFGKSLLLELVSAELDPKTGLDKSTIQDYARKIGADGDGNMQYESEFEVPSGFGEIGAILVENEHHKEMYLKDIVLDGLPNGPVNVTCNSWLHSKHDNKQKRVFFTNKLYLPSQTPDGLKRYRAEELAILRGNGQGERKTYDRIYDYDVYNDLGDPDKKPELARPVLGGKQNPYPRRCRTGRPRCDTDQSSEKREGNFYVPRDEAFSEVKQVTFSAKTVYSVLHALVPSLETAIVDPDLGFPYFSAIDALFNEGVNLPPLKQEGFWNTLLPRLVKAIEDTGDNILLFETPETMDRDKFFWFRDEEFSRQTLAGLNPYSIRLITEWPLKSTLDPEIYGPPESAITTELIEKEIGGMISVEEAIKQKKLFILDYHDLFLPYVEKVRQLKATTLYGSRTIFFLTPGGTLRPIAIELTRPPMNGKPQWKQVFLPSWHSTECWLWKLAKAHVLAHDAGYHQLVSHWLRTHCCTEPYVIATNRQLSVMHPIYRLLDPHFRYTMEINGLARQALVNADGIIESSFSPGKYSMEFSSVAYDKQWRFDHEALPKDLISRGLAVEDPSAPHGLKLTIEDYPFANDGLDLWDAIKQWVTDYVNHYYPDKSLVESDEELQAWWTEIRTVGHGDKKDEPWWPVLKTPQDLIEIITTIVWVTSGHHAAVNFGQYIYGGYFPNRPTTARCNIATEDPTDEQWKFFLEKPENALLNTFPSQIQATKVMAILDVLSTHSPDEEYLGKEIEPAWREEPVINAAFEKFRGRLMELEGIIDARNADPKLRNRNGAGMVPYELLKPFSEPGVTGKGVPYSISI

SEQ ID NO: 192 - protein, 897 aa, Citrus trifoliata
MLKPQVHQSHQSLKPLVPLSKPFLQGNVHAFRALQSSRSIKNIPKIRIGISPSVNIKAITTFTEKSTEVKAFVTIIPSVGGLVSGFVDDVKDMFGKSLLLELVSAELDPKTGAEKPTIKGFAHRAGEDKDGHIIYESKFEVPPSFGEVGAILVENEHHKEMYLNDIVLDGPRNGPVNITCGSWVQSKHVNKQKRIFFTNKSYLPSQTPNGLTRLRAEELINLRGDGQGERKTHDRIYDYDVYNDLGVPDFCSELARPVLGGKEHPYPRRCRTGRPPCETDPASESRTLINYVPRDEAFSEIKQLQFSAKTLYSVLHGLVPSLETAIIDTDLGFPYFTAIDKLFNEGVNVPMPETFKEKALWRTILPRLVKGIEDTGKEVLRFETPETMDRDKFFWFRDEEFGRQTLAGLNPYSIRLVTEWPLRSTSDPEIYGPPESAITKELIEKEIGGIMTVEEAIKQKKLFILDYHDLLLPYVEKVRELKGTTLYGSRTLFFSYPSGTLRPLAIELTRPPMDGKPQWKQVFTPSWHSTECWLWRLAKAHVLAHDSGYHQLVSHWLRTHCCTEPYIIATNRQLSAMHPINRLLQPHFRYTMEINALAREALINAGGIIESTFSPGKYSMEISSVAYDKHWRFDHEALPKDLISRGMAVEDPSASHGIKLTIEDYPFAKDGLDLWDALKQWVTDYVNHYYPNPISVESDEELQSWWTEIRTVGHADKKDEPWWPVLKTPEDLIDIITTIVWVASGHHAAVNFGQYTFGGYFPNRPTVARTKMPIEDPSDEDWKFFLEKPEDVLLQCFPSQIQATIVMAILDTLSSHSPDEEYLGKQMEQAWGDDPVIKAAFERFSGRLKELEGIIDERNANENLKNRTGAGMVPYELMKPFSEPGVTGQGVPYSISI

SEQ ID NO: 193 - protein, 894 aa, Citrus clementina
MFNPVLVHQTRSIRTILPLSKPFLHGNGNVFRQIQSSPSFKKGPKIRLGSVPSNSVKAMADTAVSNGVTAVVTVRPPINPLTAGGQVIDDVEDLFSKSLQLELVSAKDENKPTISGNAKIKGVVVKDCEVQYEAEFQVPVDFGEIGAILVVNEHALEMYLKDIVLDGLPSGLVTITCESWVQPNTSKDPRIFFTNKSYLPSKTPNGLQKLRYAELVNLRGNGEGERQKADRIYDYDVYNDLGDPDEDEELKRPVLGGKQHPYPRRCRTGRPHCKTDEASEERVPSKSLIPISPYVPRDEEFSAIKETTFVIRGLFGQLRSLIPNLKAEFVDTDGFPNFTEIDKLFREGVKIKDAEFWKSLLPGFVEEIKDIGDFFLRFTSPETFKRDRFFWFRDEEFARETLAGLNPCSIRLITEWPLKSSLDPKIYGPSESAITTEMIESEIKGCTTVKEALNQKKLFILDYHDLFLPYVEQVRELGDRTLYGSRTVFYLNPDGTLRPLAIELTRPPMDGKPQWKQAFTPSSDSTKSWLWKLAKAHVLAHDSGYHQLISHWLRTHCSVEPYAIAAHRQLSAMHPINRLLKPHFRYTMEINSLARQSLINAGGVIESTFLPGKYSMLLSSIIYDKQWRFDHQALPQDLISRGMAAKDPSSPHGLKLTIEDYPFAQDGLDLWDIIKQWVTDYVSHYYPDPSLVESDEELQAWWTEIRTVGHGDKQDETWWPVLNSPKDLIDTITSIVWVASGLHAAVNFGQYEYAAYFPNRPTIARANMPNEDPSDDEWQIFFERPEAALLTTFPNQRQATAVISVLDVLSAHSPDEDYLGKYMEPAWGEDKIIKGAFEKFQGRLMELKGIINLRNADKNLKNRHGAGSLPYELLMPLADKSGVTGKGVPYSISI

SEQ ID NO: 194 - protein, 895 aa, Citrus suavissima
MFNPVLVHQTRSIRTILPLSKPFLHGNGNVFRQIQSSPSFKKGPKIRLGSVPSNSVKAMADTAVSNGVTAVVTVRPPINPLTAGGQVIDDVEDLFSKSLQLELVSAKDENKPTISGNAKIKGVVVKDCEVQYEAEFQVPVDFGEIGAILVVNEHALEMYLKDIVLDGLPSGLVTITCESWVQPNTSKDPRIFFTNKSYLPSKTPNGLQKLRYAELVNLRGNGEGERQKADRIYDYDVYNDLGDPDEDEELKRPVLGGKQHPYPRRCRTGRPHCKTDEASEERVPSKSLIPISPYVPRDEESRRLKETTFVIKGIVSDSCVSLNTKLESRICRHRWVSQTSQKIDKLFREGVKIKDAEFWKSLLPGFVEEIKDIGDFFLRFTSPETFKRDRFFWFRDEEFSRQTLAGLNPYSIRLIAEWPLKSTLDPEIYGPPESAITTELIEKEIGGMISVEEAIKQKKLFILDYHDLFLPYVEKVRQLKSTTLYGSRTIFFLTPAGTLRPIAIELTRPPMNGKPQWKQVFLPSWHSTECWLWKLAKAHVLAHDAGYHQLVSHWLNTHCCTEPYVIATNRQLSVMHPIYRLLDPHFRYTMEINGLARQALVNADGIIESSFSPGKYSMEFSSVAYDKQWRFDHEALPKDLISRGLAVEDPSAPHGLKLTIEDYPFANDGLDLWDAIKQWVTDYVNHYYPDKSLVESDEELQAWWTEIRTVGHGDKKHEPWWPVLKTPKDLIEIITTIVWVTSGHHAAVNFGQYTYGGYFPNRPTTARCNIATEDPSDEQWKFFLEKPENALLNTFPSQIQATKVMAILDVLSTHSPDEEYLGKEIEPAWREDPVINAAFEKFRGKLMELEGIIDARNADPKLRNRNGAGMVPYELLKPFSEPGVTGKGVPYSISI

SEQ ID NO: 195 - protein, 895 aa, Citrus jambhiri
MFNPVLVHQTRSIRTILPLSKPFLHGNGNVFRQIQSSPSFKKGPKIRLGSVPSNSVKAMADTAVSNGVTAVVTVRPPINPLTAGGQVIDDVEDLFSKSLQLELVSAKDENKPTISGNAKIKGVVVKDCEVQYEAEFQVPVDFGEIGAILVVNEHALEMYLKDIVLDGLPSGLVTITCESWVQPNTSKDPRIFFTNKSYLPSKTPNGLQKLRYAELVNLRGNGEGERQKADRIYDYDVYNDLGDPDEDEELKRPVLGGKQHPYPRRCRTGRPHCKTDEASEERVPSKSLIPISPYVPRDEESRRLKETTFVIKGIVSDSCVSLNTKLESRICRHRWVSQTSQKIDKLFREGVKIKDAEFWKSLLPGFVEEIKDIGDFFLRFTSPETFKRDRFFWFRDEEFSRQTLAGLNPYSIRLIAEWPLKSTLDPEIYGPPESAITTELIEKEIGGMISVEEAIKQKKLFILDYHDLFLPYVEKVRQLKSTTLYGSRTIFFLTPAGTLRPIAIELTRPPMNGKPQWKQVFLPSWHSTECWLWKLAKAHVLAHDAGYHQLVSHWLNTHCCTEPYVIATNRQLSVMHPIYRLLDPHFRYTMEINGLARQALVNADGIIESSFSPGKYSMEFSSVAYDKQWRFDHEALPKDLISRGLAVEDPSAPHGLKLTIEDYPFANDGLDLWDAIKQWVTDYVNHYYPDKSLVESDEELQAWWTEIRTVGHGDKKDEPWWPALKTPQDLIEIITTIVWVTSGHHAAVNFGQYIYGGYFPNRPTTARCNIATEDPSDEQWKFFLEKPENALLNTFPSQIQATKVMAILDVLSTHSPDEEYLGKEIEPAWREDPVINAAFEKFRGKLMELEGIIDARNADPKLRNRNGAGMVPYELLKPFSEPGVTGKGVPYSISI

SEQ ID NO: 196 - protein, 641 aa, Citrus clementina
MFNPVLVHQTRSIRTILPLSKPFLHGNGNVFRQIQSSPSFKKGPKIRLGSVPSNSVKAMADTAVSNGVTAVVTVRPPINPLTAGGQVIDDVEDLFSKSLQLELVSAKDENKPTISGNAKIKGVVVKDCEVQYEAEFQVPVDFGEIGAILVVNEHALEMYLKDIVLDGLPSGLVTITCESWVQPNTSKDPRIFFTNKSYLPSKTPNGLQKLRYAELVNLRGNGEGERQKADRIYDYDVYNDLGDPDEDEELKRPVLGGKQHPYPRRCRTGRPHCKTDEASEERVPSKSLIPISPYVPRDEEFSAIKETTFVIRGLFGQLRSLIPNLKAEFVDTDGFPNFTEIDKLFREGVKIKDAEFWKSLLPGFVEEIKDIGDFFLRFTSPETFKRDRFFWFRDEEFARETLAGLNPCSIRLITEWPLKSSLDPKIYGPSESAITTEMIESEIKGCTTVKEALNQKKLFILDYHDLFLPYVEQVRELGDRTLYGSRTVFYLNPDGTLRPLAIELTRPPMDGKPQWKQAFTPSSDSTKSWLWKLAKAHVLAHDSGYHQLISHWLRTHCSVEPYAIAAHRQLSAMHPINRLLKPHFRYTMEINSLARQSLINAGGVIESTFLPGKYSMLLSSIIYDKQWRFDHQALPQDLISR

SEQ ID NO: 197 - protein, 900 aa, Citrus sinensis
MLKPQVHQPQSIKPLFPLSKPFLHGNYGHAFRPVQSTSTLFKGSPKLRIGSVPRNTIKAIATSTEKSIKVKAVVTVKPTVGGFLSNISLDQGLDDLGDLFGKSLLLELVSAELDPKTGLDKSTIQDYARKIGADGDGNMQYESEFEVPSGFGEIGAILVENEHHKEMYLKDIVLDGLPNGPVNVTCNSWLHSKHDNKQKRVFFTNKLYLPSQTPDGLKRYRAEELTILRGNGQGERKTYDRIYDYDVYNDLGDPDKKPELARPVLGGKQNPYPRRCRTGRPRCDTDQFSEKREGNFYVPRDEAFSEVKQLTFSAKTVYSVLHALVPSLETAFVDPDLGFPYFSAIDALFNEGVNLPPLKQEGFWNTLLPRLVKAIEDTGDNILLFETPETMDRDKFFWFRDEEFSRQTLAGLNPYSIRLITEWPLKSTLDPEIYGPPESAITTELIEKEIGGMISVEEAIKQKKLFILDYHDLFLPYVEKVRQLKSTTLYGSRTIFFLTPAGTLRPIAIELTRPPMNGKPQWKQVFLPSWHSTECWLWKLAKAHVLAHDAGYHQLVSHWLRTHCCTEPYVIATNRQLSVMHPIYRLLDPHFRYTMEINGLARQALVNADGIIESSFSPGKYSMEFSSVAYDKQWRFDHEALPKDLISRGLAVEDPSAPHGLKLTIEDYPFANDGLDLWDAIKQWVTDYVNHYYPDKSLVESDEELQAWWTEIRTVGHGDKKHEPWWPVLKTPKDLIEIITTIVWVTSGHHAAVNFGQYTYGGYFPNRPTTARCNIATEDPSDEQWKFFLEKPENALLNTFPSQIQATKVMAILDVLSTHSPDEEYLGKEIEPAWREDPVINAAFEKFRGKLMELEGIIDARNADPKLRNRNGAGMVPYELLKPFSEPGVTGKGVPYSISI

SEQ ID NO: 198 - protein, 911 aa, Citrus unshiu
MLKPQVHQPQSIKPLFPLSKPFLHGNYGHAFRPVQSTSTLFKGSPKLRIGSVPRNTIKAIATSTEKSIKVKAVVTVKPTVGGFLSNISLDQGLDDLGDLFGKSLLLELVSAELDPKTGLDKSTIQDYARKIGADGDGNMQYESEFEVPSGFGEIGAILVENEHHKEMYLKDIVLDGLPNGPVNVTCNSWLHSKHDNKQKRVFFTNKLYLPSQTPDGLKRYRAEELTILRGNGQGERKTYDRIYDYDVYNDLGDPDKKPELARPVLGGKQNPYPRRCRTGRPRCDTDQFSEKREGNFYVPRDEAFSEVKQLTFSAKTVYSVLHALVPSLETAFVDPDLGFPYFSAIDALFNEGVNLPPLKQEGFWNTLLPRLVKAIEDTGDNILLFETPETMDRDKFFWFRDEEFSRQTLAGLNPYSIRLITQEDKKLHEIAQEWPLKSTLDPEIYGPPESAITTELIEKEIGGMISVEEAIKQKKLFILDYHDLFLPYVEKVRQLKSTTLYGSRTIFFLTPAGTLRPIAIELTRPPMNGKPQWKQVFLPSWHSTECWLWKLAKAHVLAHDAGYHQLVSHWLRTHCCTEPYVIATNRQLSVMHPIYRLLDPHFRYTMEINGLARQALVNADGIIESSFSPGKYSMEFSSVAYDKQWRFDHEALPKDLISRGLAVEDPSAPHGLKLTIEDYPFANDGLDLWDAIKQWVTDYVNHYYPDKSLVESDEELQAWWTEIRTVGHGDKKHEPWWPVLKTPKDLIEIITTIVWVTSGHHAAVNFGQYTYGGYFPNRPTTARCNIATEDPSDEQWKFFLEKPENALLNTFPSQIQATKVMAILDVLSTHSPDEEYLGKEIEPAWREDPVINAAFEKFRGKLMELEGIIDARNADPKLRNRNGAGMVPYELLKPFSEPGVTGKGVPYSISI

SEQ ID NO: 199 - protein, 897 aa, Citrus clementina
MLKPQVHQSHQSLKPLVPLSKPFLRGNFHAFRALQSSSSIKNIPKIRIGISPSVNIKAITTFTQKSTQVKAFVTIKPSVGGLVSGFVDDVKDMFGKSLLLELVSAELDPKTGAEKPTIKGFAHRAGEDKDGHIIYESKFEVPPSFGEVGAILVENEHHKEMYLNDIVLDGPRNGPVNITCGSWVQSKHVNKQKRIFFTNKSYLPSQTPNGLTRLRAEELLNLRGDGQGERKTHDRIYDYDVYNDLGVPDFCSELARPVLGGKEHPYPRRCRTGRPPCETDPASESRTLINYVPRDEAFSEIKQLQFSAKTLYSVLHGLVPSLETAIIDTDLGFPYFTTIDKLFNEGVNVPMPETFKEKALWRTILPRLVKGIEDTGKEVLRFETPETMDRDKFFWFRDEEFGRQTLAGLNPYSIRLVTEWPLRSTLDPEIYGPPESAITKELIEKEIGGIMTVEEAIKQKKLFILDYHDLLLPYVEKVRELKGTTLYGSRTLFFSYPSGTLRPLAIELTRPPMDGKPQWKQVFTPSWHSTECWLWRLAKAHVLAHDSGYHQLVSHWLRTHCCTEPYIIATNRQLSAMHPINRLLQPHFRYTMEINALAREALVNAGGIIESTFSPGKYSMELSSVAYDKHWRFDHEALPKDLISRGMAVEDPSAPRGIKLTIEDYPFAKDGLDLWDALKQWVTDFVNHYYPNPSSVESDEELRSWWTEIRTVGHADKKDEPWWPVLKTPEDLIDIITTIAWVASGHHAAVNFGQYTFGGYFPNRPTVARTKMPIEDPSDEDWKLFLEKPEDVLLQCFPSQIQATTVMAILDTLSSHSPDEEYLGKQMEQAWGDDPVIKAAFERFSGRLKELEGIIDERNANENLKNRTGAGMVPYELMKPFSEPGVTGQGVPYSISI

SEQ ID NO: 200 - protein, 899 aa, Citrus clementina
MLKPQVHQPQSIKPLFPLSNPFLHGNYGHAFLPVPSTSSLFKGSPKLRIGSVPRNTIKAIATSTEKSIKVKAVVTVKPTVGSFLSNISLDRGLDDLGDLFGKSLLLELVSAELDPKTGLDKSTIQDYARKIGADGDGNMQYESEFEVPSGFGEIGAILVENEHHKEMYLKDIVLDGLPNGPVNVTCNSWLHSKHDNKQKRVFFTNKYLPSQTPDGLKRYRAEELTILRGNGQGERKTYDRIYDYDVYNDLGDPDKKPELARPVLGGKQNPYPRRCRTGRPRCDTDQFSEKREGNFYVPRDEAFSEVKQLTFSAKTVYSVLHALVPSLETAFVDPDLGFPYFSAIDALFNEGVNLPPLKQEGFWNTLLPRLVKAIEDTGDNILLFETPETMDRDKFFWFRDEEFSRQTLAGLNPYSIRLITEWPLKSTLDPEIYGPPESAITTELIEKEIGGMISVEEAIKQKKLFILDYHDLFLPYVEKVRQLKSTTLYGSRTIFFLTPAGTLRPIAIELTRPPMNGKPQWKQVFLPSWHSTECWLWKLAKAHVLAHDAGYHQLVSHWLRTHCCTEPYVIATNRQLSVMHPIYRLLDPHFRYTMEINGLARQALVNADGIIESSFSPGKYSMEFSSVAYDKQWRFDHEALPKDLISRGLAVEDPSAPHGLKLTIEDYPFANDGLDLWDAIKQWVTDYVNHYYPDKSLVESDEELQAWWTEIRTVGHGDKKHEPWWPVLKTPKDLIEIITTIVWVTSGHHAAVNFGQYIYGGYFPNRPTTARCNIATEDPSDEQWKFFLEKPENALLNTFPSQIQATKVMAILDVLSTHSPDEEYLGKEIEPAWREDPVINAAFEKFRGKLMELEGIIDARNADPKLRNRNGAGMVPYELLKPFSEPGVTGKGVPYSISI

SEQ ID NO: 201 - protein, 1752 aa, Citrus unshiu
MSYSPSQRSLTCERMLNPQVHHQSQSIRTLCPLPKPFLRGNGQAFRPAQLNPSFKKASKIGVGFSPSNNSIKAIFNLTEKSTKVKAVITVKPIIPDPLALSSLVGALGLELVSAELDPKTGEEKPTIKGLALGVLGKDDDGNIKYKAELKIPASFGDVGAILVESDQLTEMYLQDIVLDGLPNGPVNLTCDSWIQPKIVDKQKRIFFTNKSYLPSQTPNGLKRLRAEELNNLQGDGQGERKRHERIYDYDVYNDLALPEIKELARPVLGGEEHPYPRRCRTGRPKSFADPASESRSVSIYVPRDEAFADIKLGQFSASSLYSGLHALVPFLEAILIDKDLGFSSLSDIDKVFNEGIELPPELKDQPLWQKILPILFKTVSNTGKEVFRFDTPETVDRDKFFWIRNEEFGRETLAGLNPYSIKLLSQLPLKSTLDPEIYGPPESAITTELIEQEIGGLMTVNEAIKQKKLFIIDYHDALLPYVGKLRQIEGSTLYGSRALFFLNPDGTLRPLAIELTRPPLDGKPQWKQVLRTHCCVEPYIIAANRKLSAMHPINRLLKPHFRYTMEINAKARLILVNAGGLVETTFFPGKYSMEFSSVIYDKQWRFDHEALPKDLISRGMAVEDPNAPHGLKLTIEDYPFANDGLDLWDALKQWVTEYVNHYYTDPSLVESDEELQAWWTEIRTVGHADKKDEPWWPVLKTPQDLIEIVTTIAWVASGQHAAVNFGQYLYGGYFPNRPTMSRTNMPTEDQSEADWKSFLANPEDTLLQCFPSKMQAMQDMVILDTLSTHSPDEEYLGKEMEPAWGDDPVIKAAFEKFNRKMQELEGIIDDRNSNENLRNRTGAGIVPYELLKPFSGPGATGKGVPMLKPQVHQSHQSLKPLVPLSKPFLRGNFHAFRALQSSSSIKNIPKIRIGISPSVNIKAITTFTQKSTQVKAFVTIKPSVGGLVSGFVDDVKDMFGKSLLLELVSAELDPKTGAEKPTIKGFAHRAGEDKDGHIIYESKFEVPPSFGEVGAILVENEHHKEMYLNDIVLDGPRNGPVNITCGSWVQSKHVNKQKRIFFTNKSYLPSQTPNGLTRLRAEELLNLRGDGQGERKTHDRIYDYDVYNDLGVPDFCSELARPVLGGKEHPYPRRCRTGRPPCETDPASESRTLINYVPRDEAFSEIKQLQFSAKTLYSVLHGLVPSLETAIIDTDLGFPYFTTIDKLFNEGVNVPMPETFKEKALWRTILPRLVKGIEDTGKEVLRFETPETMDRDKFFWFRDEEFGRQTLAGLNPYSIRLVTEWPLRSTLDPEIYGPPESAITKELIEKEIGGIMTVEEAIKQKKLFILDYHDLLLPYVEKVRELKGTTLYGSRTLFFSYPSGTLRPLAIELTRPPMDGKPQWKQVFTPSWHSTECWLWRLAKAHVLAHDSGYHQLVKPYIIATNRQLSAMHPINRLLQPHFRYTMEINALAREALVNAGGIIESTFSPGKYSMELSSVAYDKHWRFDHEALPKDLISRGMAVEDPSAPRGIKLTIEDYPFAKDGLDLWDALKQWVTDFVNHYYPNPSSVESDEELRSWWTEIRTVGHADKKDEPWWPVLKTPEDLIDIITTIAWVASGHHAAVNFGQYTFGGYFPNRPTVARTKMPIEDPSDEDWKLFLEKPEDVLLQCFPSQIQATTVMAILDTLSSHSPDEEYLGKQMEQAWGDDPVIKAAFERFSGRLKELEGIIDERNANENLKNRTGAGMVPYELMKPFSEPGVTGQGVPYSISI

SEQ ID NO: 202 - protein, 890 aa, Citrus clementina
MLNPQVHHQSQSIRTLCPLPKPFLRGNGQAFRPAQLNPSFKKASKIGVGFSPSNNSIKAIFNLTEKSTKVKAVITVKPIIPDPLALSSLVGALGLELVSAELDPKTGEEKPTIKGLALGVLGKDDDGNIKYKAELKIPASFGDVGAILVESDQLTEMYLQDIVLDGLPNGPVNLTCDSWIQPKIVDKQKRIFFTNKSYLPSQTPNGLKRLRAEELNNLQGDGQGERKRHERIYDYDVYNDLALPEIKELARPVLGGEEHPYPRRCRTGRPKSFADPASESRSVSIYVPRDEAFADIKLGQFSASSLYSGLHALVPFLEAILIDKDLGFSSLSDIDKVFNEGIELPPELKDQPLWQKILPILFKTVSNTGKEVFRFDTPETVDRDKFFWIRNEEFGRETLAGLNPYSIKLLSQLPLKSTLDPEIYGPPESAITTELIEQEIGGLMTVNEAIKQKKLFIIDYHDALLPYVGKLRQIEGSTLYGSRALFFLNPDGTLRPLAIELTRPPLDGKPQWKQVFTPSRHSTDSWLWTLAKAHFLVHDTGYHQLISHWLRTHCCVEPYIIAANRKLSAMHPINRLLKPHFRYTMEINAKARLILVNAGGLVETTFFPGKYSMEFSSVIYDKQWRFDHEALPKDLISRGMAVEDPNAPHGLKLTIEDYPFANDGLDLWDALKQWVTEYVNHYYTDPSLVESDEELQAWWTEIRTVGHADKKDEPWWPVLKTPQDLIEIVTTIAWVASGQHAAVNFGQYLYGGYFPNRPTMSRTNMPTEDQSEADWKSFLANPEDTLLQCFPSKMQAMQDMVILDTLSTHSPDEEYLGKEMEPAWGDDPVIKAAFEKFNRKMQELEGIIDDRNSNENLRNRTGAGIVPYELLKPFSGPGATGKGVPYSISI

SEQ ID NO: 203 - protein, 802 aa, Citrus sinensis
MTANTYFVQINIYSETGAEKPTIKGFAHRAGEDKDGHIIYESKFEVPPSFGEVGAILVENEHHKEMYLNDIVLDGPRNGPVNITCGSWVQSKHVNKQKRIFFTNKSYLPSQTPNGLTRLRAEELLNLRGDGQGERKTHDRIYDYDVYNDLGVPDFCSELARPVLGGKEHPYPRRCRTGRPPCETDPASESRTLINYVPRDEAFSEIKQLQFSAKTLYSVLHGLVPSLETAIIDTDLGFPYFTTIDKLFNEGVNVPMPETFKEKALWRTILPRLVKGIEDTGKEVLRFETPETMDRDKFFWFRDEEFGRQTLAGLNPYSIRLVTEWPLRSTLDPEIYGPPESAITKELIEKEIGGIMTVEEAIKQKKLFILDYHDLLLPYVEKVRELKGTTLYGSRTLFFSYPSGTLRPLAIELTRPPMDGKPQWKQVFTPSWHSTECWLWRLAKAHVLAHDSGYHQLVSHWLRTHCCTEPYIIATNRQLSAMHPINRLLQPHFRYTMEINALAREALVNAGGIIESTFSPGKYSMELSSVAYDKHWRFDHEALPKDLISRGMAVEDPSAPRGIKLTIEDYPFAKDGLDLWDALKQWVTDFVNHYYPNPSSVESDEELRSWWTEIRTVGHADKKDEPWWPVLKTPEDLIDIITTIAWVASGHHAAVNFGQYTFGGYFPNRPTVARTKMPIEDPSDEDWKLFLEKPEDVLLQCFPSQIQATTVMAILDTLSSHSPDEEYLGKQMEQAWGDDPVIKAAFERFSGRLKELEGIIDERNANENLKNRTGAGMVPYELMKPFSEPGVTGQGVPYSISI

SEQ ID NO: 204 - protein, 762 aa, Citrus sinensis
MQYESEFEVPSGFGEIGAILVENEHHKEMYLKDIVLDGLPNGPVNVTCNSWLHSKHDNKQKRVFFTNKLYLPSQTPDGLKRYRAEELTILRGNGQGERKTYDRIYDYDVYNDLGDPDKKPELARPVLGGKQNPYPRRCRTGRPRCDTDQFSEKREGNFYVPRDEAFSEVKQLTFSAKTVYSVLHALVPSLETAFVDPDLGFPYFSAIDALFNEGVNLPPLKQEGFWNTLLPRLVKAIEDTGDNILLFETPETMDRDKFFWFRDEEFSRQTLAGLNPYSIRLITEWPLKSTLDPEIYGPPESAITTELIEKEIGGMISVEEAIKQKKLFILDYHDLFLPYVEKVRQLKSTTLYGSRTIFFLTPAGTLRPIAIELTRPPMNGKPQWKQVFLPSWHSTECWLWKLAKAHVLAHDAGYHQLVSHWLRTHCCTEPYVIATNRQLSVMHPIYRLLDPHFRYTMEINGLARQALVNADGIIESSFSPGKYSMEFSSVAYDKQWRFDHEALPKDLISRGLAVEDPSAPHGLKLTIEDYPFANDGLDLWDAIKQWVTDYVNHYYPDKSLVESDEELQAWWTEIRTVGHGDKKHEPWWPVLKTPKDLIEIITTIVWVTSGHHAAVNFGQYTYGGYFPNRPTTARCNIATEDPSDEQWKFFLEKPENALLNTFPSQIQATKVMAILDVLSTHSPDEEYLGKEIEPAWREDPVINAAFEKFRGKLMELEGIIDARNADPKLRNRNGAGMVPYELLKPFSEPGVTGKGVPYSISI

SEQ ID NO: 205 - protein, 896 aa, Citrus clementina
MLNLQFHNQSQSIRTLSPLPNPFLHGNGPAFRPAQLRPSFKKAPKIGVGFSPSINSIKAIFNLTAEKSTKVKAVITVKPIVSDPLAVEKLIGTLVLELVSAELDPETGKEKPTIKSRAHRSLFTDDDGNLKYKTEFDVPSNFGEVGAILVEADQLTETFLKDIALDGLRNGPVNIACDSWIQPKIVDKQKRIFFTNKSYLPSQTPNGLTRLRAEELNNLQGDGQGERKIHERIYDYDVYNDLGMPDSILKSDLVRPVLGGKEHPYPRRCRTGHPKSSKDPASESWSLSVYVPRDEAFSLLKTAQFSATGVYSALHAVIPFVESILRIGKDKGFPSLEAIDKLFNEGVELPPEIEKLPSWLKILPNFFKSIANTGKDILRFETPETLKRDKLFWLRDEEFGRETLAGLNPYGISLVADWPLKSTLDPETYGPTESAITKELIEKEIGGSMTVEEAIKQKKLFIIDYHDALLPYVEKVRQIKDTTLYGSRTVFFLNPDGTLRPLAIELTRPPMDGKPQWKQVFTPSTGNSTESWLWRLAKAHVLAHDSGYHQLISHWLRTHCCVEPYVIATNRRLSAMHPINRLLKPHFRYTMEINALARKVLINADGIFETNFFPGKYCMEFSSVIYDKHWRFDNEGLPKDLIRRGIAVEDPKAPHGLKLNIEDYPYANDGLDLWDALKQWVTNYVNHYYPDPSLVESDEELQAWWTEIRTVGHAEKKDEPWWPVLKTPQDLIEIITTIAWVASGHHAAVNFGQYLYGGYFPNRPTVARTNLPNEDQTKEEWKSFLEKPEAALLRCFPAQFQALTVMLVIDLLSTHSPDEEYLGKEMEPAWGDDPVIKAAFEEFNLKMQELERIIDDRNSNENLKNRTGAAIVPYELLKPFSEPGATGKGVPYSISI

SEQ ID NO: 206 - protein, 896 aa, Citrus sinensis
MLNLQFHNQSQSIRTLSPLPNPFLHGNGPAFRPAQLRPSFKKAPKIGVGFSPSINSIKAIFNLTAEKSTKVKAVITVKPIVSDPLAVEKLIGTLVLELVSAELDPETGKEKPTIKSRAHRSLFTDDDGNLKYKTEFDVPSNFGEVGAILVEADQLTETFLKDIALDGLRNGPVNIACDSWIQPKIVDKQKRIFFTNKSYLPSQTPNGLARLRAEELNNLQGDGQGERKIHERIYDYDVYNDLGMPDSILKSDLVRPVLGGKEHPYPRRCRTGHPKSSKDPASESWSLSVYVPRDEAFSLLKTAQFSATGVYSALHAVIPFVESILRIGKDKGFPSLEAIDKLFNEGVELPPEIEKLPSWLKILPNFFKSIANTGKDILRFETPETLKRDKLFWLRDEEFGRETLAGLNPYGISLVADWPLKSTLDPETYGPTESAITKELIEKEIGGSMTVEEAIKQKKLFIIDYHDALLPYVEKVRQIKDTTLYGSRTVFFLNPDGTLRPLAIELTRPPMDGKPQWKQVFTPSTGNSTESWLWRLAKAHVLAHDSGYHQLISHWLRTHCCVEPYVIATNRRLSAMHPINRLLKPHFRYTMEINALARKVLINADGIFETNFFPGKYCMEFSSVIYDKHWRFDNEGLPKDLIRRGIAVEDPKAPHGLKLNIEDYPYANDGLDLWDALKQWVTNYVNHYYPDPSLVESDEELQAWWTEIRTVGHAEKKDEPWWPVLKTPQDLIEIITTIAWVASGHHAAVNFGQYLYGGYFPNRPTVARTNLPNEDQTKEEWKSFLEKPEAALLRCFPAQFQALTVMLVIDLLSTHSPDEEYLGKEMEPAWGDDPVIKAAFEEFNLKMQELERIIDDRNSNENLKNRTGAAIVPYELLKPFSEPGATGKGVPYSISI

SEQ ID NO: 207 - protein, 892 aa, Citrus clementina
MLKPQVHRYSTPTTVLFPFSKPFLHGNCHVFRQVQPSPSLKIGSKVRVSCHSKRHNVSSKNIEAIATSTEKSVSVINAVVTVKASWKDDYEDYFLGRTLRLELVSADLDHTTGSEKSTIYAHARKAGKDKHGNELYESTFNVPSDFGEVGAMSVENEHHVEIYLMNIVLDGFSNGDPVNITCNSWIQPKNKNELKRIFFANKSYLPSQTPDGLKRFRIEELYHLRGNGQGVRQPSDRIYDYDVYNDLGNPDKRRPVLGGKKFPYPRRCRTGRPHYESDPLKEKRDKYIYVPRDETFSDVKQEAFDNMKDYKSMCHAALPYIEKFFDGDKKFEYFTEIDELFNEDGFSLPEAEPGFLNSLARFAKTLKEMGEEVFQFDAPEAMLRDKFFWFRDEEFARQTLAGLNPCSIQLITEWPLKSSLDPKIYGPQESAITKDIIEKELGEMISVEEAIEQKKLFMLDYHDLFLPYVEKVRKLEPTTLYGSRTVFFLTPDNTLRPLAIELTRPPMDDKPHWRKVYTPGSWNSTKTWLWRLAKAHVLAHDSGYHQLVSHWLRSHCVVEPYIIATNRQLSVMHPIYRLLHPHLRYTLELNAIGRDILISAGGVIENTFSPGEYCMEMSSVIYDKQWRFDEQALPKDLMKRGMAVEDPNARHGLKLTIDDYPFAKDGLDLWGILKQWVTDYVNHYYPDQSLVESDDELQAWWTEIRTVGHADKKDEPWWPVLKTPQNLIEILTTIIWVASGHHAAVNFGQYTYAAYFPNRPTIARVNMPDEDPTEKIWKTFIEKPEDALLYTFPNQDQAILVIATLDLLSTHSPDEEFLGKDKEPAWGEDPVINAAFEKFSGRLMELEGIIDERNGDSTLANRNGAGVVPYNLLKPYWKDGDKEKGVPYSISI

SEQ ID NO: 208 - protein, 894 aa, Citrus sinensis
MLKPQVHRYSTPTTVLFPFSKPFLHGNCHVFRQVQPSPSLKIGSKVRVSCHSKRHNVSSKNIEAIATSTEKSVSVINAVVTVKATWKDDYEDYLFGRTLRLELVSAELDHTTGSEKSTIYAHASKAGKDKHGNELYEATFNVPSDFGEVGAMSVENEHHVEIYLMNIVLDGFSNGDPVNITCNSWIQPKNKNEPKRIFFTNKSYLPSQTPDGLKRFRIEELYHLRGHGQGVRQPSDRIYDYDVYNDLGNPDKRRPVLGGKKFPYPRRCRTGRQHYESDPLKEKRDKYIYVPRDETFSDVKQEAFDNMKDYKSMCHAALPYIEKFFDGDKKFEYFTEIDELFNEDGFSLPEAEPGFLNSLARFAKTLKEMGEEVFQFDAPEAMLRDKFFWFRDEEFARQTLAGLNPCSIQLITEWPLKSSLDPKIYGPRLQESEITKDIIEKELGAMISVEEAIEQKKLFMLDYHDLFLPYVEKVRKLEHTTLYGSRTVFFLTPDNTLRPLAIELTRPPMDDKPLWRKVYTPGSWNSTKTWLWRLAKAHVLAHDSGYHQLVSHWLRSHCVVEPYIIATNRQLSVMHPIYRLLHPHLRYTLELNAIGRDILISAGGVIENTFSPGEYCMEMSSVIYDKQWRFDEQALPKDLMKRGMAVEDPNARHGLKLTIDDYPFAKDGLDLWGILKQWVTDYVNHYYPDQSLVESDDELQAWWTEIRTVGHADKKDEPWWPVLKTPQNLIEILTTIIWVASGHHAAVNFGQYTYAAYFPNRPTIARVNMPDEDPTEKFWKTFIEKPEDALLYTFPNQDQAILVIATLDLLSTHSPDEEFLGKGKEPAWGEDPVINAAFEKFSGRLMELEGIIDERNGDSTLVNRNGAGVVPYNLLKPYWKDGDKEKGVPYSISI

SEQ ID NO: 209 - protein, 820 aa, Citrus clementina
QKKILNQQVHRSRSIKTLIPFSKPFLHGNGRAFLPVHSSPSFQKSLKIRVGFSASNNIKAIAGATAPSVVSVKVKAVVTVKHGSEKPTINVYASVAGVDLFNIRYEAEFEVPSSFGDVGGILVQHENQKEMYLKDVVLDGFLDGPMNITCDSWVQPLAIDAQKRVFFTNKSYLPSQTPNGLTRLRDEELISLRGSGQGERQPYDRIYDYDVVARPVLGGQEHPYPRRCRTGRPHCTTDPESETRSDSNYVPRDEAFSRIKQATFSAKTLYSLLHGLIPAIKAAFGVNKDLGFPYFTAVDTLFNQGIALPPQEQEEFWGRNLPELIQLAKHILKFATMERHQFFWFRDEEFGRQTLAGLNPCAIQLVTKWPLESTLDPAIYGPPESAITTERVEKLMGGDITVAEAIQQKKLFILDYNDLLLPYVEMVRQLEGTTLYGSRTLFFLTSEGTLRPLVIELTRPPMNGQPQWKQAFQPSWQSTESWLWRLAKAHVLAHDSGYHQLVSHWLRTHACTEPYVIATNRHLSAMHPICTLLKPHLRYTMEINTLARESLINAELSSAVYDQLWRFDYEALPKDLIKRGMAVDDPTAPNGLKLTIEDYPYANDGLNLWFALKKWVTDYSDKELQAWWTEIRTVGHADKKDEPWWPALKTSEDLIEIITTIVWVASGHHAAVNFGQYAYAGYVPNRPSIARTNMPTEEPISEKDMKFFLENPQAVLLRSFPTQLQAIQVMAVLDVLSTHSPDEEYLGNQMEPAWGKDPTIFAAFERFSGRIMELEGIIDERNADMKLKNRNGAGVVPYELLKPFSGRGVTEKGVPYSISI

SEQ ID NO: 210 - protein, 732 aa, Citrus sinensis
MYLKDIVLKSESRNDDHGVKITCNSWLQPKEENTPTRIFFANKSYLPSATPDGLKRLRRQELRHLQGDGRGVRQLSDRIYDYDVYNDLGNPEKDPKLKRPVLGGKEYPYPRRCRTGRPRSELGDENRADDIYVPRDEAFSDIKLAAFDSKKTYSFVSTLPTLIETKFDGDKKFEYFTEIDELFDEDGFSIPPNLNESIWNIIPRWIRKIKETGEQYLQFETPEALHRDKFFWFRDEEFARQTLARLNPCSIQLITELPRDSSITEEIIEKKLEEILLLHRYKHYAIQQKKLFILDYHDLFLPYVEKVRHIEDEDEALKTTLYGSRTIFFLNPDDTLRPVAIELTRPPMDGKPFWRKVYTPSWNSTDSWLWRLAKAHVLAHDAGYHQLVSHWLSTHCVVEPYVIATNRQLSVIHPIYRLLHPHFRYTVEINAFARKDLVNAGGIIESTFSPGKYSMELSSVAYDKQWRFDHEALPKNLISRRMAAEDPCSPHGLKLTIEDYPYAKDGLDLWDILKKWVTDYVNHYYPNQSLVESDEELQAWWTEIRTVGHGDKEDEPWWPVLKTPQDLIETITTIIWVTSGQHAAVNFGQYTYAGYFPNRPAITRLNMPDEDKSNEIWKIFNEKPDNALLHTFPNPTQATKVMLILSLLSCHSPDEEFLGKDMEPAWGEDPEIKVAFEEFRGRLMELEGTINERNGDINLKNRNGAGVVPYNLLKPFWKDGDKEKGVPYSISI

SEQ ID NO: 211 - protein, 622 aa, Citrus sinensis
MCVLMHADQFSEKREGNFYVPRDEAFSEVKQLTFSAKTVYSVLHALVPSLETAFVDPDLGFPYFSAIDALFNEGVNLPPLKQEGFWNTLLPRLVKAIEDTGDNILLFETPETMDRDKFFWFRDEEFSRQTLAGLNPYSIRLITEWPLKSTLDPEIYGPPESAITTELIEKEIGGMISVEEAIKQKKLFILDYHDLFLPYVEKVRQLKSTTLYGSRTIFFLTPAGTLRPIAIELTRPPMNGKPQWKQVFLPSWHSTECWLWKLAKAHVLAHDAGYHQLVSHWLRTHCCTEPYVIATNRQLSVMHPIYRLLDPHFRYTMEINGLARQALVNADGIIESSFSPGKYSMEFSSVAYDKQWRFDHEALPKDLISRGLAVEDPSAPHGLKLTIEDYPFANDGLDLWDAIKQWVTDYVNHYYPDKSLVESDEELQAWWTEIRTVGHGDKKHEPWWPVLKTPKDLIEIITTIVWVTSGHHAAVNFGQYTYGGYFPNRPTTARCNIATEDPSDEQWKFFLEKPENALLNTFPSQIQATKVMAILDVLSTHSPDEEYLGKEIEPAWREDPVINAAFEKFRGKLMELEGIIDARNADPKLRNRNGAGMVPYELLKPFSEPGVTGKGVPYSISI

SEQ ID NO: 212 - protein, 667 aa, Citrus sinensis
MSIFRNQHDDYLSPIITNKKRLITSIKQYFPFSSFDHNVDLSLCTFPIADPASESRTLINYVPRDEAFSEIKQLQFSAKTLYSVLHGLVPSLETAIIDTDLGFPYFTTIDKLFNEGVNVPMPETFKEKALWRTILPRLVKGIEDTGKEVLRFETPETMDRDKFFWFRDEEFGRQTLAGLNPYSIRLVTEWPLRSTLDPEIYGPPESAITKELIEKEIGGIMTVEEAIKQKKLFILDYHDLLLPYVEKVRELKGTTLYGSRTLFFSYPSGTLRPLAIELTRPPMDGKPQWKQVFTPSWHSTECWLWRLAKAHVLAHDSGYHQLVSHWLRTHCCTEPYIIATNRQLSAMHPINRLLQPHFRYTMEINALAREALVNAGGIIESTFSPGKYSMELSSVAYDKHWRFDHEALPKDLISRGMAVEDPSAPRGIKLTIEDYPFAKDGLDLWDALKQWVTDFVNHYYPNPSSVESDEELRSWWTEIRTVGHADKKDEPWWPVLKTPEDLIDIITTIAWVASGHHAAVNFGQYTFGGYFPNRPTVARTKMPIEDPSDEDWKLFLEKPEDVLLQCFPSQIQATTVMAILDTLSSHSPDEEYLGKQMEQAWGDDPVIKAAFERFSGRLKELEGIIDERNANENLKNRTGAGMVPYELMKPFSEPGVTGQGVPYSISI

SEQ ID NO: 213 - protein, 633 aa, Citrus unshiu
MCVLMHADQFSEKREGNFYVPRDEAFSEVKQLTFSAKTVYSVLHALVPSLETAFVDPDLGFPYFSAIDALFNEGVNLPPLKQEGFWNTLLPRLVKAIEDTGDNILLFETPETMDRDKFFWFRDEEFSRQTLAGLNPYSIRLITQEDKKLHEIAQEWPLKSTLDPEIYGPPESAITTELIEKEIGGMISVEEAIKQKKLFILDYHDLFLPYVEKVRQLKSTTLYGSRTIFFLTPAGTLRPIAIELTRPPMNGKPQWKQVFLPSWHSTECWLWKLAKAHVLAHDAGYHQLVSHWLRTHCCTEPYVIATNRQLSVMHPIYRLLDPHFRYTMEINGLARQALVNADGIIESSFSPGKYSMEFSSVAYDKQWRFDHEALPKDLISRGLAVEDPSAPHGLKLTIEDYPFANDGLDLWDAIKQWVTDYVNHYYPDKSLVESDEELQAWWTEIRTVGHGDKKHEPWWPVLKTPKDLIEIITTIVWVTSGHHAAVNFGQYTYGGYFPNRPTTARCNIATEDPSDEQWKFFLEKPENALLNTFPSQIQATKVMAILDVLSTHSPDEEYLGKEIEPAWREDPVINAAFEKFRGKLMELEGIIDARNADPKLRNRNGAGMVPYELLKPFSEPGVTGKGVPYSISI

SEQ ID NO: 214 - protein, 690 aa, Citrus unshiu
MYLKDVVLDGFLDGPMNITCDSWVQPLAIDAQKRVFFTNKSYLPSQTPNGLTRLRDEELISLRGSGQGERQPYDRIYDYDVVARPVLGGQEHPYPRRCRTGRPHCTTDPESETRSDSNYVPRDEAFSRIKQATFSAKTLYSLLHGLIPAIKAAFGENKDLGFPYFTAIDTLFNQGIALPPQEQEEFWGRNLPELIQLAKHILKFATMERHQFFWFRDEEFGRQTLAGLNPCAIQLVTKWPLESTLDPAIYGPPESAITTERVEKLMGGDITVAEAIEQKKLFILDYNDLLLPYVEKVRQLEGTTLYRSRTLFFLTSEGTLRPLVIELTRPPMNGQPQWKQAFQPSWQSTESWLWRLAKAHVLAHDSGYHQLVSHWLRTHACTEPYVTATTRHLSAMHPICTLLKPHLRYTMETNTLARESLINAELSSAVYDQLWRFDYEALPKDLIKRGMAVDDPTAPNGLKLTIEDYPYANDGLNLWFALKKWVTEYSDKELQAWWTEIRTVGHADKKDEPWWPALKTSEDLIEIITTIVWVASGHHAAVNFGQYAYAGYVPNRPSIARTNMPTEEPISEKDMKFFLENPQVVLLRSFPTQLQAIQVMAVLDVLSTHSPDEEYLGNQMEPTWGKDPTIFAAFERFSGRMMELEGIIDERNADMKLKNRNGARVVPYELLKPFSGRGVTEKGVPYSISI

SEQ ID NO: 215 - protein, 619 aa, Citrus unshiu
MADPLKEKRDKYIYVPRDETFSDVKQEAFDNMKDYKSMCHAALPYIEKFFDGDKKFEYFTEIDELFNEDGFSLPEAEPGFLNSLARFAKTLKEMGEEVFQFDAPEAMLRDKFFWFRDEEFARQTLAGLNPCSIQLITEWPLKSSLDPKIYGPRLQESEITKDIIEKELGAMISVEEAIEQKKLFMLDYHDLFLPYVEKVRKLEHTTLYGSRTVFFLTPDNTLRPLAIELTRPPMDDKPLWRKVYTPGSWNSTKTWLWRLAKAHVLAHDSGYHQLVSHWLRSHCVVEPYIIATNRQLSVMHPIYRLLHPHLRYTLELNAIGRDILISAGGVIENTFSPGEYCMEMSSVIYDKQWRFDEQALPKDLMKRGMAVEDPNARHGLKLTIDDYPFAKDGLDLWGILKQWVTDYVNHYYPDQSLVESDDELQAWWTEIRTVGHADKKDEPWWPVLKTPQNLIEILTTIIWVASGHHAAVNFGQYTYAAYFPNRPTIARVNMPDEDPTEKFWKTFIEKPEDALLYTFPNQDQAILVIATLDLLSTHSPDEEFLGKGKEPAWGEDPVINAAFEKFSGRLMELEGIIDERNGDSTLVNRNGAGVVPYNLLKPYWKDGDKEKGVPYSISI

SEQ ID NO: 216 - protein, 2015 aa, Citrus trifoliata
MEALFELCDLIAQNPKQFSEKLAWICNRCPQPELLLSGSPRVSRSHLNAVLAVARFLSKCGDSADSRPKSVILEFIRAIPSSFSRSFWPQAFSTSDSISSCFTEFLGYVSKSCDDSPDFAAEVAGLTGEVIISAVCCYGAEDSGITRAFLLASSKNFPPILPSDANKLVTVLLEQLALPIPASPREHIPINSGTSSSQSSPLSANHLQPSQSNGSESSPGNEGASIVSGSSVSMNGGASIFGGFTMNDGQQFRQQVASFEEESVESLEKQEIAFKLITHVLDKVQIDTKPLEQIRFLAKRQLQSMSAFLKIRKRDWTEQGPLLKARINAKLSVYQSVARLKIKSLASLDMEGKTSKRLVLETLALLVDAAESCLLSVWRKLRVCEELFSSLLAGIAQIAVIRGGQPLRVLLIRLKPLVLTACAQGDTWGSSKGAMFETVMKTSCEIIESGWTKDRAPVDTFIMGLATSIRERNDYDEQVEKEKQAVPAVQLNVIRLLADLTVAVNKSEVVDMILPLFIESLEEGDASTPSLLRLRLLDAVSHMASLGFEKSYRETVVLMTRSYLSKLSIVGSAESKTMAAEATTERVETLPAGFLLIAGGLRNAKLRSDYRQRLLSLCSDVGLAAESKSGRSGADFLGPLLPAVAEICSDFDPTVDVEPSLLKLFRNLWFYIALFGLAPPIQKTQPPVKSVSSTLNSVGSMGTIPLQAVTGPYMWNTQWSSAVQHIAQGTPPLVVSSVKWLEDELELNALHNPGSRRGSGNEKAAGTQRAALSAALGGRVEVAAMSTISGVKATYLLAVAFLEIIRFSSNGGILNGGTSLTAARSAFSCVFEYLKTPNLMPSVFQCLNAIVLRAFETAVSWLEERTAETGKEAEIKESTLFAHACFLIKSMSQREEHLRDTAVNLLTHLRDKFPQVLWHSSCLDSLLFSFDSDASSAVINDPAWVATVRSLYQRLVREWVLTSLSYAPCTTQGLLQDKLCKANNWQRVQPTTDMVSLLSEIRIGTCKNDCWPGIRTANIPAVTAAAAAASGATLKPAEALEVLSTGIVSATVKCNHAGEIAGMRRLYNSIGGFQSGTMPTGSFGFGGGFQRLISGAFSQQPQTEDDSFNEMLLSKFVHLLQQFVNVAEKGGEVDKGQFRETCSQATALLLSNLDSNSKSNVEGFSQLLRLLCWCPAYISTPDAMETGVFIWTWLVSAAPQLGSLVLAELVDAWLWTIDTKRGLFATDVRYSGPAAKLRPHLAPGEPEPQPEIDPVQQIIAHRLWLGFFIDRFEVVRHNSVEQLLLLGRMLQGTTNFPWKFSRHPAAAGTFFTLMLLGLKFCSCQSQGYLQNFKSGLQLLEDRIYRASLGWFAYEPEWYDINCVNFAQSEAQSLSLFLHYLLNERADAVHHDAKGRGHENGSALVDVNDQFHPIWGQIENYDVGREKRKQLLLMLCQHEADRLDVWAHPIISKESVSSRPRISSEKLVEYARTAFQVDPRIALSLASRFPANASLKAEVTQLVQLHILDIRCIPEALPYFVTPKAVDEDSALLQQLPHWAACSITQALEFLTPAYKGHPRVMAYILRVLESYPPERVTFFMPQLVQALRYDDERLVEGYLLRATQRSDIFAHILIWHLQGETFVPESGKEKDANSVKNSSFQTLLPMVRHRIIDGFNPKARDLFQREFDFFDKVTNISGALYPLPKEERRAGIRRELEKIEMEGEDLYLPTAPNKLVRGIRVDSGIPLQSAAKVPIMITFNVVDRDGDQSNVMPQACIFKVGDDCRQDVLALQVISLLRDIFEAVGINLYLFPYGVLPTGPEKGIIEVVPNTRSRSQMGETTDGGLYEIFQQDFGPVGSTSFEAARENFIISSAGYAVASLLLQPKDRHNGNLLFDNMGRLVHIDFGFILETSPGRNMRFESAHFKLSHEMTQLLDPSGGMKSDTWNQFVSLCIKGYLAARRFMDGIINTVLLMLDSGLPCFSRGDPIGNLRKRFHPEMSDREAAIFMRNVCTDAYNKWTTAGYDLIQYLQQGIEK

SEQ ID NO: 217 - protein, 2019 aa, Citrus clementina
MEALFELCDLIAQNPKQFSEKLAWICNRCPQPELLLSGSPRVSRSHLNAVLAVARFLSKCGDSADSRPKSVILEFIRAIPSSFNRSFWPQAFSTSDSISSFFTEFLGYVSKSCDDSPDFAAEVAGLTGEVIISAVCCYGAEDSGITRAFLLASSKNFPPILPSDANKLVTVLLEQLALPIPASPREHIPINSGTSSSQSSPLSANHLQPSQSNGSESSPGNEGASIVSGSSVSMNGGASIFGGFTMNDGQQFGQQFRQQVASFEEESVESLEKQEIAFKLITHVLDKVQIDTKLLEQIRFLAKRQLQSMSAFLKIRKRDWTEQGPLLKARINAKLSVYQSVARLKIKSLASLDMEGKTSKRLVLETLALLVDAAESCLLSVWRKLRVCEELFSSLLAGIAQIAVIRGGQPLRVLLIRLKPLVLTACAQGDTWGSSKGAMFETVMKTSCEIIESGWTKDRAPVDTFIMGLATSIRERNDYDEQVEKEKQAVPAVQLNVIRLLADLTVAVNKSEVVDMILPLFIESLEEGDASTPSLLRLRLLDAVSHMASLGFEKSYRETVVLMTRSYLSKLSIVGSAESKTMAAEATTERVETLPAGFLLIAGGLRNAKLRSDYRHRLLSLCSDVGLAAESKSGRSGADFLGPLLPAVAEICSDFDPTVDVEPSLLKLFRNLWFYIALFGLAPPIQKTQPPVKSVSSTLNSVGSMGTIPLQAVTGPYMWNTQWSSAVQHIAQGTPPLVVSSVKWLEDELELNALHNPGSRRGSGNEKAAGTQRAALSAALGGRVEVAAMSTISGVKATYLLAVAFLEIIRFSSNGGILNGGTSLTAARSAFSCVFEYLKTPNLMPSVFQCLNAIVLRAFETAVSWLEERTAETGKEAEIKESTLFAHACFLIKSMSQREEHLRDTAVNLLTQLRDKFPQVLWHSSCLDSLLFSFDSDASSAVINDPAWVATVRSLYQRLVREWVLTSLSYAPCTTQGLLQDKLCKANNWQRAQPTTDMVSLLSEIRIGTCKNDCWPGIRTANIPAVTAAAAAASGATLKPAEALEVLSTGIVSATVKCNHAGEIAGMRRLYNSIGGFQSGTMPTGSFGFGGGFQRLISGAFSQQPQTEDDSFNEMLLSKFVHLLQQFVNVAEKGGEVDKGQFRETCSQATALLLSNLDSNSKSNVEGFSQLLRLLCWCPAYISTPDAMETGVFIWTWLVSAAPQLGSLVLAELVDAWLWTIDTKRGLFATDVRYSGPAAKLRPHLAPGEPEPQPEIDPVQQIIAHRLWLGFFIDRFEVVRHNSVEQLLLLGRMLQGTTNFPWKFSRHPAAAGTFFTLMLLGLKFCSCQSQGYLQNFKSGLQLLEDRIYRASLGWFAYEPEWYDINCVNFAQSEAQSLSLFLHYLLNERADAFQHDAKGRGHENGSALVDVNDQFHPIWGQIENYDVGREKRKQLLLMLCQHEADRLDVWAHPIISKESVSSRPRISSEKLVEYARTAFQVDPRIALSLASRFPANASLKAEVTQLVQLHILDIRCIPEALPYFVTPKAVDEDSALLQQLPHWAACSITQALEFLTPAYKGHPRVMAYILRVLESYPPERVTFFMPQLVQALRYDDERLVEGYLLRATQRSDIFAHILIWHLQGETFVPESGKEKDANSVKNGSFQTLLPMVRQRIIDGFNPKALDLFQREFDFFDKVTNISGALYPLPKEERRAGIRRELEKIEMAGEDLYLPTAPNKLVRGIRVDSGIPLQSAAKVPIMITFNVVDRDGDQSNVMPQACIFKVGDDCRQDVLALQVISLLRDIFEAVGLNLYLFPYGVLPTGPERGIIEVVPNTRSRSQMGEITDGGLYEIFQQDFGPVGSTSFEAARENFIISSAGYAVASLLLQPKDRHNGNLLFDNIGRLVHIDFGFILETSPGRNMRFESAHFKLSHEMTQLLDPSGVMKSDTWNQFVSLCIKGYLAARRYMDGIINTVLLMLDSGLPCFSRGDPIGNLRKRFHPEMSDREAAIFMRNVCTDAYNKWTTAGYDLIQYLQQGIEK

SEQ ID NO: 218 - protein, 2015 aa, Citrus sinensis
MEALFELCDLIAQNPKQFSEKLAWICNRCPQPELLLSGSPRVSRSHLNAVLAVARFLSKCGDSADSRPKSVILEFIRAIPSSFNRSFWPQAFSTSDSISSFFTEFLGYVSKSCDDSPDFAAEVAGLTGEVIISAVCCYGAEDSGITRAFLLASSKNFPPILPSDANKLVTVLLEQLALPIPASPREHIPINSGTSSSQSSPLSANHLQPSQSNGSESSPGNEGASIVSGSSVSMNGGASIFGGFTMNDGQQFRQQVASFEEESVESLEKQEIAFKLITHVLDKVQIDTKLLEQIRFLAKRQLQSMSAFLKIRKRDWTEQGPLLKARINAKLSVYQSVARLKIKSLSSLDMEGKTSKRLVLETLALLVDAAESCLLSVWRKLRVCEELFSSLLAGIAQIAVIRGGQPLRVLLIRLKPLVLTACAQGDTWGSSKGAMFETVMKTSCEIIESGWTKDRAPVDTFIMGLATSIRERNDYDEQVEKEKQAVPAVQLNVIRLLADLTVAVNKSEVVDMILPLFIESLEEGDASTPSLLRLRLLDAVSHMASLGFEKSYRETVVLMTRSYLSKLSIVGSAESKTMAAEATTERVETLPAGFLLIAGGLRNAKLRSDYRHRLLSLCSDVGLAAESKSGRSGADFLGPLLPAVAAICSDFDPTVDVEPSLLKLFRNLWFYIALFGLAPPIQKTQPPVKSVSSTLNSVGSMGTIPLQAVTGPYMWNTQWSSAVQHIAQGTPPLVVSSVKWLEDELELNALHNPGSRRGSGNEKAAGTQRAALSAALGGRVEVAAMSTISGVKATYLLAVAFLEIIRFSSNGGILNGGTSLTAARSAFSCVFEYLKTPNLMPSVFQCLNAIVLRAFETAVSWLEERTAETGKEAEIKESTLFAHACFLIKSMSQREEHLRDTAVNLLTQLRDKFPQVLWHSSCLDSLLFSFDSDASSAVINDPAWVATVRSLYQRLVREWVLTSLSYAPCTTQGLLQDKLCKANNWQRAQPTTDMVSLLSEIRIGTCKNDCWPGIRTANIPAVTAAAAAASGATLKPAEALEVLSTGIVSATVKCNHAGEIAGMRRLYNSIGGFQSGTMPTGSFGFGGGFQRLISGAFSQQPQTEDDSFNEMLLSKFVHLLQQFVNVAEKGGEVDKGQFRETCSQATALLLSNLDSNSKSNVEGFSQLLRLLCWCPAYISTPDAMETGVFIWTWLVSAAPQLGSLVLAELVDAWLWTIDTKRGLFATDVRYSGPAAKLRPHLAPGEPEPQPEIDPVQQIIAHRLWLGFFIDRFEVVRHNSVEQLLLLGRMLQGTTNFPWKFSRHPAAAGTFFTLMLLGLKFCSCQSQGYLQNFKSGLQLLEDRIYRASLGWFAYEPEWYDINCVNFAQSEAQSLSLFLHYLLNERADAFQHDAKGRGHENGSALVDVNDQFHPIWGQIENYDVGREKRKQLLLMLCQHEADRLDVWAHPIISKESVSSRPRISSEKLVEYARTAFQVDPRIALSLASRFPANASLKAEVTQLVQLHILDIRCIPEALPYFVTPKAVDEDSALLQQLPHWAACSITQALEFLTPAYKGHPRVMAYILRVLESYPPERVTFFMPQLVQALRYDDERLVEGYLLRATQRSDIFAHILIWHLQGETFVPESGKEKDANSVKNGSFQTLLPMVRQRIIDGFNPKALDLFQREFDFFDKVTNISGALYPLPKEERRAGIRRELEKIEMAGEDLYLPTAPNKLVRGIRVDSGIPLQSAAKVPIMITFNVVDRDGDQSNVMPQACIFKVGDDCRQDVLALQVISLLRDIFEAVGLNLYLFPYGVLPTGPEKGIIEVVPNTRSRSQMGETTDGGLYEIFQQDFGPVGSTSFEAARENFIISSAGYAVASLLLQPKDRHNGNLLFDNIGRLVHIDFGFILETSPGRNMRFESAHFKLSHEMTQLLDPSGVMKSDTWNQFVSLCIKGYLAARRYMDGIINTVLLMLDSGLPCFSRGDPIGNLRKRFHPEMSDREAAIFMRNVCTDAYNKWTTAGYDLIQYLQQGIEK

SEQ ID NO: 219 - protein, 2111 aa, Citrus unshiu
MEALFELCDLIAQNPKQFSEKLAWICNRCPQPELLLSGSPRVSRSHLNAVLAVARFLSKCGDSADSRPKSVILEFIRAIPSSFNRSFWPQAFSTSDSISSFFTEFLGYVSKSCDESPDFAAEVAGLTGEVIISAVCCYGAEDSGITRAFLLASSKNFPPILPSDANKLVTVLLEQLALPIPASPREHIPINSGTSSSQSSPLSANHLQPSQSNGSESSPGNEGASIVSGSSVSMNGGASIFGGFTMNDGQQFRQQVASFEEESVESLEKQEIAFKLITHVLDKVQIDTKLLEQIRFLAKRQLQSMSAFLKIRKRDWTEQGPLLKARINAKLSVYQSVARLKIKSLASLDMEGKTSKRLVLETLALLVDAAESCLLSVWRKLRVCEELFSSLLAGIAQIAVIRGGQPLRVLLIRLKPLVLTACAQGDTWGSSKGAMFETVMKTSCEIIESGWTKDRAPVDTFIMGLATSIRERNDYDEQVEKEKQAVPAVQLNVIRLLADLTVAVNKSEVVDMILPLFIESLEEGDASTPSLLRLRLLDAVSHMASLGFEKSYRETVVLMTRSYLSKLSIVGSAESKTMAAEATTERVETLPAGFLLIAGGLRNAKLRSDYRHRLLSLCSDVGLAAESKSGRSGADFLGPLLPAVAAICSDFDPTVDVEPSLLKLFRNLWFYIALFGLAPPIQKTQPPVKSVSSTLNSVGSMGTIPLQAVTGPYMWNTQWSSAVQHIAQGTPPLVVSSVKWLEDELELNALHNPGSRRGSGNEKAAGTQRAALSAALGGRVEVAAMSTISGVKATYLLAVAFLEIIRFSSNGGILNGGTSLTAARSAFSCVFEYLKTPNLMPSVFQCLNAIVLRAFETAVSWLLKCKYCAFYLEACTSGGALLVLFLHLSLPDRAIDFCGNIALLEERTAETGKEAEIKESTLFAHACFLIKSMSQREEHLRDTAVNLLTQLRDKFPQVLWHSSCLDSLLFSFDSDASSAVINDPAWVATVRSLYQRLVREWVLTSLSYAPCTTQGLLQDKLCKANNWQRAQPTTDMVSLLSEIRIGTCKNDCWPGIRTANIPAVTAAAAAASGATLKPAEALEVLSTGIVSATVKCNHAGEIAGMRRLYNSIGGFQSGTMPTGSFGFGGGFQRLISGAFSQQPQTEDDSFNEMLLSKFVHLLQQFVNVAEKGGEVDKGQFRETCSQATALLLSNLVTIYFSSSFLHILGIENYSLRKCFILIYVRVHVFFFSFLCQDSNSKSNVEGFSQLLRLLCWCPAYISTPDAMETGVFIWTWLVSAAPQLGSLVLAELVDAWLWTIDTKRGLFATDVRYSGPAAKLRPHLAPGEPEPQPEIDPVQQIIAHRLWLGFFIDRFEVVRHNSVEQLLLLGRMLQGTTNFPWKFSRHPAAAGTFFTLMLLGLKFCSCQSQGYLQNFKSGLQLLEDRIYRASLGWFAYEPEWYDINCVNFAQSEAQSLSLFLHYLLNERADAFQHDAKGRGHENGSALVDVNDQFHPIWGQIENYDVGREKRKQLLLMLCQHEADRLDVWAHPIISKESVSSRPRISSEKLVEYARTAFQVDPRIALSLASRFPANASLKAEVTQLVQASWSGEMAVALHILDIRCIPEALPYFVTPKAVDEDSALLQQLPHWAACSITQALEFLTPAYKGHPRVMAYILRVLESYPPERVTFFMPQLVQALRYDDEVSNRLVEGYLLRATQRSDIFAHILIWHLQGETFVPESGKEKDANSVKNGSFQTLLPMVRQRIIDGFNPKALDLFQREFDFFDKVTNISGALYPLPKEERRAGIRRELEKIEMVGEDLYLPTAPNKLVRGIRVDSGIPLQSAAKVPIMITFNVVDRDGDQSNVMPQACIFKVGDDCRQDVLALQVISLLRDIFEAVGLNLYLFPYGVLPTGPERGIIEVVPNTRSRSQMGETTDGGLYEIFQQDFGPVGSTSFEAARENFIISSAGYAVASLLLQPKDRHNGNLLFDNIGRLVHIDFGFILETSPGRNMRFESAHFKLSHEMTQLLDPSGVMKSDTWNQFVSLCIKGYLAARRYMDGIINTVLLMLDSGLPCFSRGDPIGNLRKRFHPEMSDREAAIFMRNVCTDAYNKWTTAGYDLIQYLQQGIEK

SEQ ID NO: 220 - protein, 1646 aa, Citrus clementina
MEALFELCDLIAQNPKQFSEKLAWICNRCPQPELLLSGSPRVSRSHLNAVLAVARFLSKCGDSADSRPKSVILEFIRAIPSSFNRSFWPQAFSTSDSISSFFTEFLGYVSKSCDDSPDFAAEVAGLTGEVIISAVCCYGAEDSGITRAFLLASSKNFPPILPSDANKLVTVLLEQLALPIPASPREHIPINSGTSSSQSSPLSANHLQPSQSNGSESSPGNEGASIVSGSSVSMNGGASIFGGFTMNDGQQFGQQFRQQVASFEEESVESLEKQEIAFKLITHVLDKVQIDTKLLEQIRFLAKRQLQSMSAFLKIRKRDWTEQGPLLKARINAKLSVYQSVARLKIKSLASLDMEGKTSKRLVLETLALLVDAAESCLLSVWRKLRVCEELFSSLLAGIAQIAVIRGGQPLRVLLIRLKPLVLTACAQGDTWGSSKGAMFETVMKTSCEIIESGWTKDRAPVDTFIMGLATSIRERNDYDEQVEKEKQAVPAVQLNVIRLLADLTVAVNKSEVVDMILPLFIESLEEGDASTPSLLRLRLLDAVSHMASLGFEKSYRETVVLMTRSYLSKLSIVGSAESKTMAAEATTERVETLPAGFLLIAGGLRNAKLRSDYRHRLLSLCSDVGLAAESKSGRSGADFLGPLLPAVAEICSDFDPTVDVEPSLLKLFRNLWFYIALFGLAPPIQKTQPPVKSVSSTLNSVGSMGTIPLQAVTGPYMWNTQWSSAVQHIAQGTPPLVVSSVKWLEDELELNALHNPGSRRGSGNEKAAGTQRAALSAALGGRVEVAAMSTISGVKATYLLAVAFLEIIRFSSNGGILNGGTSLTAARSAFSCVFEYLKTPNLMPSVFQCLNAIVLRAFETAVSWLEERTAETGKEAEIKESTLFAHACFLIKSMSQREEHLRDTAVNLLTQLRDKFPQVLWHSSCLDSLLFSFDSDASSAVINDPAWVATVRSLYQRLVREWVLTSLSYAPCTTQGLLQDKLCKANNWQRAQPTTDMVSLLSEIRIGTCKNDCWPGIRTANIPAVTAAAAAASGATLKPAEALEVLSTGIVSATVKCNHAGEIAGMRRLYNSIGGFQSGTMPTGSFGFGGGFQRLISGAFSQQPQTEDDSFNEMLLSKFVHLLQQFVNVAEKGGEVDKGQFRETCSQATALLLSNLDSNSKSNVEGFSQLLRLLCWCPAYISTPDAMETGVFIWTWLVSAAPQLGSLVLAELVDAWLWTIDTKRGLFATDVRYSGPAAKLRPHLAPGEPEPQPEIDPVQQIIAHRLWLGFFIDRFEVVRHNSVEQLLLLGRMLQGTTNFPWKFSRHPAAAGTFFTLMLLGLKFCSCQSQGYLQNFKSGLQLLEDRIYRASLGWFAYEPEWYDINCVNFAQSEAQSLSLFLHYLLNERADAFQHDAKGRGHENGSALVDVNDQFHPIWGQIENYDVGREKRKQLLLMLCQHEADRLDVWAHPIISKESVSSRPRISSEKLVEYARTAFQVDPRIALSLASRFPANASLKAEVTQLVQLHILDIRCIPEALPYFVTPKAVDEDSALLQQLPHWAACSITQALEFLTPAYKGHPRVMAYILRVLESYPPERVTFFMPQLVQALRYDDELLCRVWTRWPSNDKKYPILGKLKLYKESQKKCWDGQQKYPSTTVKAEQPK

SEQ ID NO: 221 - protein, 484 aa, Citrus trifoliata
MFVLRLHSVDDNHPITIEEAGFSTVSSTATRSSANPNPKFSERRGLVHLFRGTSQSYQQNPNSRSTCIFVVAVPNYLSSDEFVRFCGFHIDHVEELIFIRNDAMEDRYSVLIKLVDQLTADEFYSNLNGKRFSPAEAEVCHMLFMLSVEYTELAEIASTPPAGFTELPTCPICLERLDPDTSGILSTICDHSFQCSCTAKWTVLSCQVCRFCHQQDERPTCSVCGTVENLWVCLICGFVGCGRYKEGHAVRHWKDTQHWYSLDLRTQQIWDYVGDNYVHRLNQSKADGKLVEMNSPCMSHEAHCGTCECSEDSGISGALFNSKVEAIVDEYNRLLATQLETQRQYYESLLAEAKSKRESLIPETVEKAVASKMQDIQNELEICEEAKKAVADVNSKLIKNQEIMRKKFKEIEEREKTSLRLRDATILDLEEQIRDLTVYIEAQKTLTNMTDSDGIKGGTVLPVSYQQSSPTNTRRHKKSSRRKN

SEQ ID NO: 222 - protein, 423 aa, Citrus clementina
MFVLRVHSVDDNHPITIEEAGFCTVSSTATRSSANPNPKFSERRGLVHLFRGTSQSYQQNPNSRSTCIFVVAVPNYLSSDEFVRFCGSHIDHVEELIFIRNDAMEDRYSVLIKLVDQLTADEFYSNLNGKRFSPAEAEVCHMLFMLSVEYTELAEIASTPPAGFTELPTCPICLERLDPDTSGILSTICDHSFQCSCTAKWTVLSCQVCRFCHQQDERPTCSVCGTVENLWVCLICGFVGCGRYKEGHAVRHWKDTQHWYSLDLRTQQIWDYVGDNYVHRLNQSKADGKLVEMNSPCMSHEAHCGTCECSEDSGISGALFNSKVEAIVDEYNRLLATQLETQRQYYESLLAEAKSKRESLIPETVEKAVASKMQDIQNELDICEEAKKAVADVNPLTTHFRSVILFFFWGVGGCYLMLLIETF

SEQ ID NO: 223 - protein, 423 aa, Citrus sinensis
MFVLRVHSVDDNHPITIEEAGFCTVSSTATRSRANPNPKFSERRGLVHLFRGTSQSYQQNPNSRSTCIFVVAVPNYLSSDEFVRFCGSHIDHVEELIFIRNDAMEDRYSVLIKLVDQLTADEFYSNLNGKRFSPAEAEVCHMLFMLSVEYTELAEIASTPPAGFTELPTCPICLERLDPDTSGILSTICDHSFQCSCTAKWTVLSCQVCRFCHQQDERPTCSVCGTVENLWVCLICGFVGCGRYKEGHAVRHWKDTQHWYSLDLRTQQIWDYVGDNYVHRLNQSKADGKLVEMNSPCMSHEAHCGTCECSEDSGISGALFNSKVEAIVDEYNRLLATQLETQRQYYESLLAEAKSKRESLIPETVEKAVASKMQDIQNELDICEEAKKAVADVNPLTTHFRSVILFFFGGVGGCYLMLLIETF

SEQ ID NO: 224 - protein, 484 aa, Citrus clementina
MFVLRVHSVDDNHPITIEEAGFCTVSSTATRSSANPNPKFSERRGLVHLFRGTSQSYQQNPNSRSTCIFVVAVPNYLSSDEFVRFCGSHIDHVEELIFIRNDAMEDRYSVLIKLVDQLTADEFYSNLNGKRFSPAEAEVCHMLFMLSVEYTELAEIASTPPAGFTELPTCPICLERLDPDTSGILSTICDHSFQCSCTAKWTVLSCQVCRFCHQQDERPTCSVCGTVENLWVCLICGFVGCGRYKEGHAVRHWKDTQHWYSLDLRTQQIWDYVGDNYVHRLNQSKADGKLVEMNSPCMSHEAHCGTCECSEDSGISGALFNSKVEAIVDEYNRLLATQLETQRQYYESLLAEAKSKRESLIPETVEKAVASKMQDIQNELDICEEAKKAVADVNSKLIKNQEIMRKKFKEIEEREITSLRLRDATILDLEEQIRDLTVYIEAQKTLTNMTDSDGIKGGTVLPVSYQQSSPTNTRRHKKSSRRKN

SEQ ID NO: 225 - protein, 481 aa, Citrus unshiu
MFVLRVHSVDDNHPITIEEAGFCTVSSTATRSRANPNPKFSERRGLVHLFRGTSQSYQQNPNSRSTCIFVVAVPNYLSSDEFVRFCGSHIDHVEELIFIRNDAMEDRYSVLIKLVDQLTADEFYSNLNGKRFSPAEAEVCHMLFMLSVEYTELAEIASTPPAGFTELPTCPICLERLDPDTSGILSTICDHSFQCSCTAKWTVLSCQVCRFCHQQDERPTCSVCGTVENLWVCLICGFVGCGRYKEGHAVRHWKDTQHWYSLDLRTQQIWDYVGDNYVHRLNQSKADGKLVEMNSPCMSHEAHCGTCECSEDSGISGALFNSKVEAIVDEYNRLLATQLETQRQYYESLLAEAKSKRESLIPETVEKAVASKMQDIQNELDICEEAKKAVADVNSKLIKNQEIMRKKFKEIEEREITSLRLRDATILDLEEQIRDLTVYIEAQKTLTNMTDSDGIKGGTVLPVSYQQSSPTNTRRHKKSNS

SEQ ID NO: 226 - protein, 484 aa, Citrus sinensis
MFVLRVHSVDDNHPITIEEAGFCTVSSTATRSRANPNPKFSERRGLVHLFRGTSQSYQQNPNSRSTCIFVVAVPNYLSSDEFVRFCGSHIDHVEELIFIRNDAMEDRYSVLIKLVDQLTADEFYSNLNGKRFSPAEAEVCHMLFMLSVEYTELAEIASTPPAGFTELPTCPICLERLDPDTSGILSTICDHSFQCSCTAKWTVLSCQVCRFCHQQDERPTCSVCGTVENLWVCLICGFVGCGRYKEGHAVRHWKDTQHWYSLDLRTQQIWDYVGDNYVHRLNQSKADGKLVEMNSPCMSHEAHCGTCECSEDSGISGALFNSKVEAIVDEYNRLLATQLETQRQYYESLLAEAKSKRESLIPETVEKAVASKMQDIQNELDICEEAKKAVADVNSKLIKNQEIMRKKFKEIEEREITSLRLRDATILDLEEQIRDLTVYIEAQKTLTNMTDSDGIKGGTVLPVSYQQSSPTNTRRHKKSSRRKN

SEQ ID NO: 227 - protein, 472 aa, Citrus unshiu
MFVLRVHSVDDNHPITIEEAGFCTVSSTATRSRANPNPKFSERRGLVHLFRGTSQSYQQNPNSRSTCIFVVAVPNYLSSDEFVRFCGSHIDHVEELIFISVLIKLVDQLTADEFYSNLNGKRFSPAEAEVCHMLFMLSVEYTELAEIASTPPAGFTELPTCPICLERLDPDTSGILSTICDHSFQCSCTAKWTVLSCQVCRFCHQQDERPTCSVCGTVENLWVCLICGFVGCGRYKEGHAVRHWKDTQHWYSLDLRTQQIWDYVGDNYVHRLNQSKADGKLVEMNSPCMSHEAHCGTCECSEDSGISGALFNSKVEAIVDEYNRLLATQLETQRQYYESLLAEAKSKRESLIPETVEKAVASKMQDIQNELDICEEAKKAVADVNSKLIKNQEIMRKKFKEIEEREITSLRLRDATILDLEEQIRDLTVYIEAQKTLTNMTDSDGIKGGTVLPVSYQQSSPTNTRRHKKSNS

SEQ ID NO: 228 - protein, 356 aa, Citrus sinensis
MFVLRVHSVDDNHPITIEEAGFCTVSSTATRSRANPNPKFSERRGLVHLFRGTSQSYQQNPNSRSTCIFVVAVPNYLSSDEFVRFCGSHIDHVEELIFIRNDAMEDRYSVLIKLVDQLTADEFYSNLNGKRFSPAEAEVCHMLFMLSVEYTELAEIASTPPAGFTELPTCPICLERLDPDTSGILSTICDHSFQCSCTAKWTVLSCQVCRFCHQQDERPTCSVCGTVENLWVCLICGFVGCGRYKEGHAVRHWKDTQHWYSLDLRTQQIWDYVGDNYVHRLNQSKADGKLVEMNSPCMSHEAHCGTCECSEDSGISGALFNSKVEAIVDEYNRLLATQLETQRQVSTSFPDVKTPT

SEQ ID NO: 229 - protein, 391 aa, Citrus sinensis
MSSNTVRNDAMEDRYSVLIKLVDQLTADEFYSNLNGKRFSPAEAEVCHMLFMLSVEYTELAEIASTPPAGFTELPTCPICLERLDPDTSGILSTICDHSFQCSCTAKWTVLSCQVCRFCHQQDERPTCSVCGTVENLWVCLICGFVGCGRYKEGHAVRHWKDTQHWYSLDLRTQQIWDYVGDNYVHRLNQSKADGKLVEMNSPCMSHEAHCGTCECSEDSGISGALFNSKVEAIVDEYNRLLATQLETQRQYYESLLAEAKSKRESLIPETVEKAVASKMQDIQNELDICEEAKKAVADVNSKLIKNQEIMRKKFKEIEEREITSLRLRDATILDLEEQIRDLTVYIEAQKTLTNMTDSDGIKGGTVLPVSYQQSSPTNTRRHKKSSRRKN

SEQ ID NO: 230 - protein, 490 aa, Solanum tuberosum
MFTLQIHTVDSPQPIPTTIATTSSAAHGPKPNSDLTSSSGSLHLSELRGIAHLFRHLPSSTSTTISNPISRTTTVFIVAAPNYLSPDDFLLFCGTHLADFTHVMFLKNDGIEHSYSVLINIVNQLAADGFYCSFNGKRFKPTEVEVCHIYFIQSVVYEESAYITSTPPVGYTELPTCPVCLERLDQDTSGIQSTLCDHSFQCSCVSKWTYLACQVCRLCQQQDEKPACSECGTMKNLCVCLICGFVGCGRYEKKHAIKHWTDAAHHYSLELETQQIWDYVGDKYVHRLNQSKGDSKLVTVNSRCTATEGECTTCGDDEDSSFSGALFSSKVDSIVDEYNNLLASQLETQRQHYESLLAEAKSGKESSISRAVEKAVFSKLNDLQAKIEMYTEETKSIVERNQVLLKNQELLQTKYRETAERERLLLKSKDENKLDLKEQIRDLKVYVEAQRKLSNMGISDGKGGTVLSVEPNKQSSSNSRRRGKLGRRRN

SEQ ID NO: 231 - protein, 318 aa, Citrus trifoliata
MSIRIGSVLGVVTSSPDVTKELLKTNDVTFAARKSSAAIECLTYNSSFAFAPNGPYWQFMKKLTAVELLGSRTLCQFLPIRTNELRELIRFLFEKSKSGQSVNITDELLKFANNIISQMMLSIRCSSKGGQAEECRTLAREVTEIFGEVNISDIIWIFKSFDIQGFHRRFKDIHRRYDSLLENIITNREKLRKEKKESEEKVKDLLDILLDVLENPNSEIKLTRDHIKALCLDFLTAGTDTSSTTLEWSLAELINHPMVLQKAQQEIDQVVGRNRLVQESDVPHLPYIQAIIKESFRIHPPIPLISRKAVETVKLATT

SEQ ID NO: 232 - protein, 503 aa, Citrus clementina
MTLQPLIFYASLFILSALVLKAIKHSRRLPPSPWALPIVGHLHLLGPSLHHSFHKLSTRYGPLMSIRIGSVLGVVTSSPDVTKELLKTNDVTFAARNSSAAIECLTYNSSFAFAPNGPYWQFMKKLTTVELLGSRTLLQFLPIRTNELHELIRFLFEKSKSGGSVNITDELLKFTNNIISQMMLSIRCSGKGGQAEECRTLAREVTEIFGEFNISDVIWVFKSFDIQGFRRRFKDIHRRFDSLLENIITNREKLRKEKKESEEKVKDLLDILLDVLENQNSEIKLTRDHIKALFLDFLTAGTDTSSMTVEWALAELINHPMVLQKAQQEIDQVVGRNRLVQESDVPHLPYIQVIIKESFRIHPPIPLLNRRALEDCKIGNYIIPKGTLLFVNLWSMGRDPETWKNPLEFQPERFLSESNSEIDVRGLHYRLLPFGTGRRGCPGLSLAMQELPTTLAAMIQCFNFKVTSPDGVVDMSERPGLSSPRAQDLVCVPVARCAPSIVN

SEQ ID NO: 233 - protein, 501 aa, Citrus sinensis
MTLQPLIFYASLFILSALVLKAIKHSRRLPPSPWALPIVGHLHLLGPSLHHSFHKLSTRYGPLMSIRIGSVLGVVTSSPDVTKELLKTNDVTFAARNSSAAIECLTYNSSFAFAPNGPYWQFMKKLTTVELLGSRTLLQFLPIRTNELHELIRFLFEKSKSGGSVNITDELLKFTNNIISQMMLSIRCSGKGGQAEECRTLAREVTEIFGEFNISDIIWIFKSFDIQGFRRRFKDIHRRFDSLLENIITNREKLRKEKKESEEKVKDLLDILLDVLENQNSEIKLTRDHIKALFLDFLTAGTDTSSMTVEWALAELINHPMVLQKAQQEIDQVFGRNRLVQLKNHLPYIQAIIKESFRIHPPIPLISRKAVEDCKIGNYVIPKDTVLFVNLWSMGRDPKIWKNPLEFQPERFLSQSNSEIDVKGLHYQFLPFGTGRRGCPGLSLAMQELPTTLAAMIQCFNFKVTSPDGVVDMSERPGLSSPRAQDLVCVPVARCAPSILN

SEQ ID NO: 234 - protein, 738 aa, Citrus sinensis
MLSAHLNGSAQEPYRSFLAMTLQPLIFYASLFILSALVLKAIKHSRRLPPSPWALPIVGHLHLLGPSLHHSFHKLSTRYGPLMSIRIGSVLGVVTSSPDVTKELLKTNDVTFAARNSSAAIECLTYNSSFAFAPNGPYWQFMKKLTTVELLGSRTLLQFLPIRTNELHELIRFLFEKSKSGGSVSITDELLKFTNNIISQMMLSIRCSGKGGQAEECRTLAREVTEIFGEFNISDIIWIFKSFDIQGFRRRFKDIHRRFDSLLENIITNREKLRKEKKESEEKVKDLLDILLDVLENQNSEIKLTRDHIKALFLDFLTAGTDTSSMTVEWALAELINHPMVLQKAQQEIDQVVGRNRLVQESDFPRLPYIQAIIKESFRIHPPIPLISRKAVEDCKIGNYVIPKDTVLFVNLWSMGRDPKIWKNPLEFQPERFLSQSNSEIDVRGLHYQLLPFGTGRRGCPGLSLAMQELPATLAAMIQCFNFKVTSPDGVVDMSERPQLSSPRARDLMCVPVARCPLTSLLLSVQDFLTAGTDTSSMTVEWALAELINHPMVLQKAQQEIDQVVGRNRLVQESDFPRLPYIQAIIKESFRIHPPIPLLNRRALEDCKIGNYIIPKGTLLFVNLWSMGRDPKIWKNPLEFQPERFFSQSNSEIDVRGLHYQLLPFGTGRRGCPGLSLAMQELPTALASMIQCFDFKVTSPDGVVDMSERPGLSSPRAQDLVCVPVARCAPSIVNSDVR

SEQ ID NO: 235 - protein, 503 aa, Citrus sinensis
MTLQPLIFYASLFVLSALVLKAIKHSRRLPPSPWALPIVGHLHLLGPSLHHSFHKLSTRYGPLMSVRIGSVLGVVTSCPDVTKELLKTNDVTFTGRKSSAAIECLTYNSSFAFAPYGPYWQFMKKLSAVELLGSRTLHQFLPVRTNELRELIRFLFEKSKSGQSVNITDELLRFANNIISQMMLSIRCSGKGGQAEECRTLAREVTEIFGEFNISDIIWIFKSFDIQGFNRRFKDIHRRYDSQLENIITNREKLRKEKKESEEKVKDLLDILLDVLENQNSEIKLTRDHVKALCVDFLTAGTDTSSTSLEWSLAELINHPMVLQEAQQELDQVVGRNRLVQESDVPHLPYIQAIIKESFRIHPPIPLISRKAVEDCKIGNYVIPKDTVLFVNLWSMGRDPKIWKNPLEFQPERFLSQSNSEIDVKGLHYQFLPFGTGRRGCPGLSLAMQELPATLAAMIQCFNFKVTSPDGVVDMSERPGLSSPRAQDLVCVPVARCAPSILN

SEQ ID NO: 236 - protein, 503 aa, Citrus unshiu
MTLQPLIFYASLFILSALVLKAIKHSRRLPPSPWALPIVGHLHLLGPSLHHSFHKLSTRYGPLMSVRIGSVLGVVTSCPDVTKELLKTNDVTFTGRKSSAAIECLTYNSSFAFAPYGPYWRFMKKLSAVELLGSRTLHQFLPVRTNELRELIRFLFEKSKSGQSVNITDELLRFANNIISQMMLSIRCSGKGGQAEECRTLAREVTEIFGEFNISDIIWIFKSFDIQGFNRRFKDIHRRYDSQLENIITNREKLRKEKKESEEKVKDLLDILLDVLENQNSEIKLTRDHVKALCVDFLTAGTDTSSTSLEWSLAELINHPMVLQEAQQELDQVVGRNRLVQESDVPHLPYIQAIIKESFRIHPPIPLISRKAVEDCKIGNYVIPKDTVLFVNLWSMGRDPKIWKNPLEFQPERFLSQSNSEIDVKGLHYQFLPFGTGRRGCPGLSLAMQELPATLAAMIQCFNFKVTSPDGVVDMSERPGLASPRAQDLVCVPVARCAPSILN

SEQ ID NO: 237 - protein, 503 aa, Citrus clementina
MTLQPLIFYASLFILSALVLKAIKHSRRLPPSPWALPIVGHLHLLGPSLHHSFHKLSTRYGPLMSVRIGSVLGVVTSCPDVTKELLKTNDVTFTGRKSSAAIECLTYNSSFAFAPYGPYWRFMKKLSAVELLGSRTLHQFLPVRTNELRELIRFLFEKSKSGQSVNITDELLRFANNIISQMMLSIRCSGKGGQAEECRTLAREVTEIFGEFNISDIIWIFKSFDIQGFNRRFKDIHRRYDSQLENIITNREKLRKEKKESEEKVKDLLDILLDVLENQNSEIKLTRDHVKALCVDFLTAGTDTSSTSLEWSLAELINHPMVLQEAQQELDQVVGRNRLVQESDVPHLPYIQAIIKESFRIHPPIPLISRKAVEDCKIGNYVIPKDTVLFVNLWSMGRDPKIWKNPLEFQPERFLSQSNSEIDVKGLHYQFLPFGTGRRGCPGLSLAMQELPATLAAMIQCFNFKVTSPDGVVDMTERPGLASPRAQDLVCVPVARCAPSILN

SEQ ID NO: 238 - protein, 391 aa, Citrus clementina
SLFLLSALVLKAIKNSGRLPPSPWALLIVGHLHLLGPSLHHSFHKLSTCYGPLMSICIGSVLGVVTSSPDVTKERLKTNDVTFAARNSSAAIECLTYNSSFAFAPNGPYWLFMKKLTTVELLGSRTLRQFLPIRTNKLHELIRFLFEKSKSGESVNIRDELLKFTNNIISPMMLSIRCSGKGGQAEECRTLAREVAEIFGEFKSFDIQGFHRRFKDIHRRFDSLLENVITNREKLRKEKKESEEKVKGLLDILLDCSGESEFGDQVSVHLFRNIPFLYFGFPHSWHRYFIHDVQWALAELINHPMVLQKAQQEIDQVVGRNGPVQESYVPHLPYIQAIIKESFRIHPPIPLLNRRALEDCKIGNYISPKGTLLFVNLWSMGRVLDHKLDPR

SEQ ID NO: 239 - protein, 214 aa, Citrus trifoliata
MSEKICDKHGCRRRKIFRTIIAGILIFVVIVLITILIVWAILRPTKPRFILQDATVYVFNVSNPNVLTSSFQVTISSRNPNDRIGIYYDRLDLYATYHSQQITYKTSLPTTYQGHKEINVWSPYVYGNAVPVAPYNAVSLTQDQSGGIIPLMFKIDGRVRWKVGTFITGKYHLYVRCSAYINFGNKQAGNAVCNNAVCNNAVKYQLVQSCSVSV

SEQ ID NO: 240 - protein, 209 aa, Citrus clementina
MSEKVCDKHGCKRRKIFRRIIAGILIFILIVLITILIVWAILRPTKPRFILQDATVYVFNVSNPNVLTSSFQVTISSRNPNDRIGIYYDKLDLYATYHNQQITYKTSLPTTYQGHKEINVWSPYVYGNAVPVAPYNAVSLTQDQSSGIIPLMFKIDGRVRWKVGTFITGKYHLYVRCSAYINFGDRQAGTAVGNNAVKYQLVQSCSVSV

SEQ ID NO: 241 - protein, 209 aa, Citrus sinensis
MSEKVCDKHGCKRRKIFRRIIAGILIFILIVLITILIVWAILRPTKPRFILQDATVYVFNVSNPNVLTSSFQVTISSRNPNDRIGIYYDKLDLYATYHSQQITYKTSLPTTYQGHKEINVWSPYVYGNAVPVAPYNAVSLTQDQSSGIIPLMFKIDGRVRWKVGTFITGKYHLYVRCPAYINFGDRQAGTAVGNNAVKYQLVQSCSVSV

SEQ ID NO: 242 - protein, 209 aa, Citrus sinensis
MSEKVCDKHGCKRRKIFRRIIAGILIFILIVLITILIVWAILRPTKPRFILQDATVYVFNVSNPNVLTSSFQVTISSRNPNDRIGIYYDKLDLYATYHSQQITYKTSLPTTYQGHKEVNVWSPYVYGNAVPVAPYNAVSLTQDQSSGIIPLTFKIDGRVRWKVGTFITGKYHLYVRCPAYINFGDRQAGTAVGNNAVKYQLVQSCSVSV

SEQ ID NO: 243 - protein, 212 aa, Citrus unshiu
MSEKDCGHSHDDRKKLVRLILNAVGGLIIVVLLIIFLFWAITRPSKPSFILQDATLYAFNLSTGPSPPNALTTNLQVTITTRNPNDKIGIYYQKADVYASYRNQQISLATLLPATYQGHKDVIVWSPFLYGNSVPVSPFVAESLGQDLNAGMVMVNIKVDGRIKWKVGTWISGRYHLHVNCPAYITFGDKSKGIASGASLKFQLVQSCSVDV

SEQ ID NO: 244 - protein, 212 aa, Citrus clementina
MSEKDCGHSHDDKKKLVRLILYAVGGLIIVVLLIIFLFWAITRPSKPSFILQDATLYAFNLSTGPSPPNALTTNLQVTITTRNPNDKIGIYYQKADVYASYRNQQISLATLLPATYQGHKDVIVWSPFLYGNSVPVSPFVAEALGQDLNAGMVMVNIKVDGRIKWKVGTWISGRYHLHVNCPAYITFGDKSKGIASGASVKFQLVQSCSVDV

SEQ ID NO: 245 - protein, 212 aa, Citrus sinensis
MSEKDCGHSHDDRKKLVRLILYAVGGLIIVVLLIIFLFWAITRPSKPSFILQDATLYAFNLSTGPSPPNALTTNLQVTITTRNPNDQIGIYYQKADVYASYRNQQISLATLLPATYQGHKDVIVWSPFLCGNSVPVSPFVAEALGQDLNAGMVMVNIKVDGRIKWKVGTWISGRYHLHVNCPAYITFGDKSKGIASGASLKFQLVQSCSVDV

SEQ ID NO: 246 - protein, 123 aa, Citrus unshiu
MTESLDLYATYHSQQITYKTSLPTTYQGHKEVNVWSPYVYGNAVPVAPYNAVSLTQDQSSGIIPLTFKIDGRVRWKVGTFITGKYHLYVRCPAYINFGDRQAGTAVGNNAVKYQLVQSCSVSV

SEQ ID NO: 247 - protein, 211 aa, Solanum tuberosum
MSVKECTHHKDKKRKLVRRLFAGILIFLFVVLLTVLLVWAILQPKKPRFILQDATIFNFNVSAPNIFSTSIQITIYSRNPNDKIGVYYDKMKTYANYHKQQITYYTQIPSVYQGHKDVNIWSPFVFSNNVPISPLNGPDLKEDQQNGGVWLDFKIDGRVKWRVGTITTGHYHLHVTCTAYVPFGNHPGDGGLFVGNNAVKYQLARSCDVSV

SEQ ID NO: 248 - protein, 663 aa, Citrus trifoliata
MRVVLVDFRFTYAIVLSLLWVSSSVIGRSNAASSLLNDPFYGISPQDENYYKTSSNTIKCKDGSKKFAKTQLNDDYCDCPDGTDEPGTSACPNGKFYCQNAGHSPLMIFSSKVNDGICDCCDGSDEYDGKVKCPNTCWEAGKVARDKLKKKIATYQEGVLLRKKEIEQAKQNLVKDEAELSNLKNEEKILKGLVQQLKERKEQIEKAEEKERLQREKEEKERKEAEENERKEKSESGEKDMQEKNKAEENAYSDDKPDDVRHDDKVGVLEEESFDQGKAGNVDEEPATEAKQIGTSQNLGTPVNGVEQHATEEMEQSASSRSKDGSSTVPETSSDAENQMPPEAEKKEEKNLENGVSENTEELSREELGRLVASRWTGEKTEKQSGEGGAIENDDQGEDVPEYNHDDEEDRYATDTDDDSERYDTEKYDDNDVEDDIDETYREEDHDYTSTSYKTDVDDDLDMSEMTTPSSPSWLEKVQQTVRNILQAVNLFQTPVDKSDAARVRKEYDESSDKLSKIQSRISSLTQKLKHDFGPEKEFYSFHGHCFESKQNKYVYKVCPYKKATQEEGHSTTRLGSWDKFEDSYHIMLFSNGDKCWNGPDRSMKVRLRCGLKNEVTDVDEPSRCEYVALLSTPAVCSEEKLQELEHKLDELNKKQPQHHDEL

SEQ ID NO: 249 - protein, 558 aa, Citrus trifoliata
MPEWKILLSECRTFPLMIFSSKVNDGICDCCDGSDEYDGKVKCPNTCWEAGKVARDKLKKKIATYQEGVLLRKKEIEQAKQNLVKDEAELSNLKNEEKILKGLVQQLKERKEQIEKAEEKERLQREKEEKERKEAEENERKEKSESGEKDMQEKNKAEENAYSDDKPDDVRHDDKVGVLEEESFDQGKAGNVDEEPATEAKQIGTSQNLGTPVNGVEQHATEEMEQSASSRSKDGSSTVPETSSDAENQMPPEAEKKEEKNLENGVSENTEELSREELGRLVASRWTGEKTEKQSGEGGAIENDDQGEDVPEYNHDDEEDRYATDTDDDSERYDTEKYDDNDVEDDIDETYREEDHDYTSTSYKTDVDDDLDMSEMTTPSSPSWLEKVQQTVRNILQAVNLFQTPVDKSDAARVRKEYDESSDKLSKIQSRISSLTQKLKHDFGPEKEFYSFHGHCFESKQNKYVYKVCPYKKATQEEGHSTTRLGSWDKFEDSYHIMLFSNGDKCWNGPDRSMKVRLRCGLKNEVTDVDEPSRCEYVALLSTPAVCSRKSFRNWNIN

SEQ ID NO: 250 - protein, 663 aa, Citrus clementina
MRVVLVDFRFTYAIVLSLLWVSSSVIGRSNAASSLLNDPFYGISPQDENYYKTSSNTIKCKDGSKKFAKTQLNDDYCDCPDGTDEPGTSACPNGKFYCQNAGHSPLMIFSSKVNDGICDCCDGSDEYDGKVKCPNTCWEAGKVARDKLKKKIATYQEGVLLRKKEIEQAKQNLVKDEAELSNLKNEEKILKGLVQQLKERKEQIEKAEEKERLQREKEEKERKEAEENERKEKSESGEKAMQEKNKAEENAYSDDKPDDVRHDDKVGVLEEESFDQGKAENVDEEPATEAKQIGTSQNLGTPVNGVEQHATEEMEQSASSRSKDGSSTVPETSSDAESQMPPEAEKKEEKNLENGVSENTEELSREELGRLVASRWTGEKTEKQSGEGGAIANDDQGEDVPEYNHDDEEDRYATDTDDDSERYDTEKYDDNDVEDDIDEPYREEDHDYTSTSYKTDVDDDLDMSEMTTPSSPSWLEKIQQTVRNILQAVNLFQTPVDKSDAARVRKEYDESSDKLSKIQSRISSLTQKLKHEFGPEKEFYSFYGHCFESKQNKYVYKVCPYKKATQEEGHSTTRLGSWDKFEDSYHIMLFSNGDKCWNGPDRSMKVRLRCGLKNEVTDVDEPSRCEYVALLYTPAVCSEEKLQELQHKLDELNKKQPQHHDEL

SEQ ID NO: 251 - protein, 631 aa, Citrus sinensis
MRVVLVDFRFTYAIVLSLLWVSSSVIGRSNAASSLLNDPFYGISPQDENYYKTSSNTIKCKDGSKKFAKTQLNDDYCDCPDGTDEPDCCDGSDEYDGKVKCPNTCWEAGKVARDKLKKKIATYQEGVLLRKKEIEQAKQNLVKDEAELSNLKNEEKILKGLVQQLKERKEQIEKAEEKERLQREKEEKERKEAEENERKEKSESGEKAMQEKNKAEENAYSDDKPDDVRHDDKVGVLEEESFDQGKAENVDEEPATEAKQIGTSQNLGTPVNGVEQHATEEMEQSASSRSKDGSSTVPETSSDAESQMPPEAEKKEEKNLENGVSENTEELSREELGRLVASRWTGEKTEKQSGEGGAIANDDQGEDVPEYNHDDEEDRYATDTDDDSERYDTEKYDDNDVEDDIDEPYREEDHDYTSTSYKTDVDDDLDMSEMTTPSSPSWLEKIQQTVRNILQAVNLFQTPVDKSDAARVRKEYDESSDKLSKIQSRISSLTQKLKHEFGPEKEFYSFYGHCFESKQNKYVYKVCPYKKATQEEGHSTTRLGSWDKFEDSYHIMLFSNGDKCWNGPDRSMKVRLRCGLKNEVTDVDEPSRCEYVALLYTPAVCSEEKLQELQHKLDELNKKQPQHHDEL

SEQ ID NO: 252 - protein, 619 aa, Citrus unshiu
MRVVLVDFRFTYAIVLSLLWVSSSVIGRSNAASSLLNDPFYGISPQDENYYKTSSNTIKCKDGSKKFAKTQLNDDYCDCPDGTDEPGTSACPNGKFYCQNAGHSPLMIFSSKVNDGICDCCDGSDEYDGKVKCPNTCWEAGKVARDKLKKKIATYQEGVLLRKKEIEQAKQNLVKDEAELSNLKNEEKILKGLVQQLKERKEQIEKAEEKERLQREKEEKERKEAEENERKEKSESGEKAMQEKNKAEENAYSDDKPDDVRHDDKVGVLEEESFDQGKAENVDEEPATEAKQIGTSQNLGTPVNGVEQENGVSENTEELSREELGRLVASRWTGEKTEKQSGEGGAIANDDQGEDVPEYNHDDEEDRYATDTDDDSERYDTEKYDDNDVEDDIDEPYREEDHDYTSTSYKTDVDDDLDMSEMTTPSSPSWLEKIQQTVRNILQAVNLFQTPVDKSDAARVRKEYDESSDKLSKIQSRISSLTQKLKHEFGPEKEFYSFYGHCFESKQNKYVYKVCPYKKATQEEGHSTTRLGSWDKFEDSYHIMLFSNGDKCWNGPDRSMKVRLRCGLKNEVTDVDEPSRCEYVALLYTPAVCSEEKLQELQHKLDELNKKQPQHHDEL

SEQ ID NO: 253 - protein, 608 aa, Citrus sinensis
MRVVLVDFRFTYAIVLSLLWVSSSVIGRSNAASSLLNDPFYGISPQDENYYKTSSNTIKCKDGSKKFAKTQLNDDYCDCPDGTDEPGTSACPNGKFYCQNAGHSPLMIFSSKVNDGICDCCDGSDEYDGKVKCPNTCWEAGKVARDKLKKKIATYQEGVLLRKKEIEQAKQNLVKDEAELSNLKNEEKILKGLVQQLKERKEQIEKAEEKERLQREKEEKERKEAEENERKEKSESGEKAMQEKNKAEENAYSDDKPDDVRHDDKVGVLEEESFDQGKAENVDEEPATEAKQIGTSQNLGTPVNGVEQHATEEMEQSASSRSKDGSSTVPETSSDAESQMPPEAEKKEEKNLENGVSENTEELSREELGRLVASRWTGEKTEKQSGEGGAIANDDQGEDVPEYNHDDEEDRYATDTDDDSERYDTEKYDDNDVEDDIDEPYREEDHDYTSTSYKTDVDDDLDMSEMTTPSSPSWLEKIQQTVRNILQAVNLFQTPVDKSDAARVRKEYDESSDKLSKIQSRISSLTQKLKHEFGPEKEFYSFYGHCFESKQNKYVYKVCPYKKATQEEGHSTTRLGSWDKFEDSYHIMLFSNGDKCWNGPDRSMKVTL

SEQ ID NO: 254 - protein, 631 aa, Citrus unshiu
MRVVLVDFRFTYAIVLSLLWVSSSVIGRSNAASSLLNDPFYGISPQDENYYKTSSNTIKCKDGSKKFAKTQLNDDYCDCPDGTDEPGTSACPNGKFYCQNAGHSPLMIFSSKVNDGICDCCDGSDEYDGKVKCPNTCWEAGKVARDKLKKKIATYQEGVLLRKKEIEQAKQNLVKDEAELSNLKNEEKILKGLVQQLKERKEQIEKAEEKERLQREKEEKERKEAEENERKEKSESGEKAMQEKNKAEENAYSDDKPDDVRHDDKVGVLEEESFDQGKAENVDEEPATEAKQIGTSQNLGTPVNGVEQENGVSENTEELSREELGRLVASRWTGEKTEKQSGEGGAIANDDQGEDVPEYNHDDEEDRYATDTDDDSERYDTEKYDDNDVEDDIDEPYREEDHDYTSTSYKTDVDDDLDMSEMTTPSSPSWLEKIQQTVRNILQAVNLFQTPVDKSDAARVRKEYDESSDKLSKIQSRISSLTQKLKHEFGPEKEFYSFYGHCFESKQNKYVYKVCPYKKATQEEGHSTTRLGSWDKFEDSYHIMLFSNGDKCWNGPDRSMKFNEFNYKCIVLQVRLRCGLKNEVTDVDEPSRCEYVALLYTPAVCSEEKLQELQHKLDELNKKQPQHHDEL

SEQ ID NO: 255 - protein, 583 aa, Citrus sinensis
MRVVLVDFRFTYAIVLSLLWVSSSVIGRSNAASSLLNDPFYGISPQDENYYKTSSNTIKCKDGSKKFAKTQLNDDYCDCPDGTDEPGTSACPNGKFYCQNAGHSPLMIFSSKVNDGICDCCDGSDEYDGKVKCPNTCWEAGKVARDKLKKKIATYQEGVLLRKKEIEQAKQNLVKDEAELSNLKNEEKILKGLVQQLKERKEQIEKAEEKERLQREKEEKERKEAEENERKEKSESGEKAMQEKNKAEENAYSDDKPDDVRHDDKVGVLEEESFDQGKAENVDEEPATEAKQIGTSQNLGTPVNGVEQHATEEMEQSASSRSKDGSSTVPETSSDAESQMPPEAEKKEEKNLENGVSENTEELSREELGRLVASRWTGEKTEKQSGEGGAIANDDQGEDVPEYNHDDEEDRYATDTDDDSERYDTEKYDDNDVEDDIDEPYREEDHDYTSTSYKTDVDDDLDMSEMTTPSSPSWLEKIQQTVRNILQAVNLFQTPVDKSDAARVRKEYDESSDKLSKIQSRISSLTQKLKHEFGPEKEFYSFYGHCFESKQNKYVYKVCPYKKATQEEGHSTTRLGILFVLPP

SEQ ID NO: 256 - protein, 563 aa, Citrus sinensis
MRVVLVDFRFTYAIVLSLLWVSSSVIGRSNAASSLLNDPFYGISPQDENYYKTSSNTIKCKDGSKKFAKTQLNDDYCDCPDGTDEPGTSACPNGKFYCQNAGHSPLMIFSSKVNDGICDCCDGSDEYDGKVKCPNTCWEAGKVARDKLKKKIATYQEGVLLRKKEIEQAKQNLVKDEAELSNLKNEEKILKGLVQQLKERKEQIEKAEEKERLQREKEEKERKEAEENERKEKSESGEKAMQEKNKAEENAYSDDKPDDVRHDDKVGVLEEESFDQGKAENVDEEPATEAKQIGTSQNLGTPVNGVEQHATEEMEQSASSRSKDGSSTVPETSSDAESQMPPEAEKKEEKNLENGVSENTEELSREELGRLVASRWTGEKTEKQSGEGGAIANDDQGEDVPEYNHDDEEDRYATDTDDDSERYDTEKYDDNDVEDDIDEPYREEDHDYTSTSYKTDVDDDLDMSEMTTPSSPSWLEKIQQTVRNILQAVNLFQTPVDKSDAARVRKEYDESSDKLSKIQSRISSLTQKLKHEFGPEKEFYSFYGHCFESKQNKLLFLTLFSSI

SEQ ID NO: 257 - protein, 587 aa, Citrus unshiu
MRVVLVDFRFTYAIVLSLLWVSSSVIGRSNAASSLLNDPFYGISPQDENYYKTSSNTIKCKDGSKKFAKTQLNDDYCDCPDGTDEPDCCDGSDEYDGKVKCPNTCWEAGKVARDKLKKKIATYQEGVLLRKKEIEQAKQNLVKDEAELSNLKNEEKILKGLVQQLKERKEQIEKAEEKERLQREKEEKERKEAEENERKEKSESGEKAMQEKNKAEENAYSDDKPDDVRHDDKVGVLEEESFDQGKAENVDEEPATEAKQIGTSQNLGTPVNGVEQENGVSENTEELSREELGRLVASRWTGEKTEKQSGEGGAIANDDQGEDVPEYNHDDEEDRYATDTDDDSERYDTEKYDDNDVEDDIDEPYREEDHDYTSTSYKTDVDDDLDMSEMTTPSSPSWLEKIQQTVRNILQAVNLFQTPVDKSDAARVRKEYDESSDKLSKIQSRISSLTQKLKHEFGPEKEFYSFYGHCFESKQNKYVYKVCPYKKATQEEGHSTTRLGSWDKFEDSYHIMLFSNGDKCWNGPDRSMKVRLRCGLKNEVTDVDEPSRCEYVALLYTPAVCSEEKLQELQHKLDELNKKQPQHHDEL

SEQ ID NO: 258 - protein, 632 aa, Solanum tuberosum
MELRFQFVFLLSCIFCICSIDRSVSLPSIVNLGIAPEDENYYKGLSSGAINCKDGSKKFTKAQLNDDFCDCPDGSDEPGTSACPSGKFYCKNAGHAPLFIYSSRVNDGICDCCDGSDEHDGKVKCPNTCWEVGRVARDKLKKKIATFQEGIIIRKKEIEEAKLAIAKEETEVSKLKNEQKILKGRVEQLQDKKEQIEKVEEEERLKREKEEKERKEADDAKLEASKVEEKTEVHEEAVKSDIHDKIGLLEDSPPVKDVVEGHDKAADEEQHGDHSVKDEFPVDEVEQVPEDSSQHPEIKEASTNNNKADVSSRNEEKDAAENIESLSKEELGRVIGSRWLGKKSEQETESVEAGTDSNHDNHDEVPSDTHEEEYHGYDSDVDDRKYDDEHKYDDDENKYDDDDNEDHVEDSVGEDHDSSSSYKSESDDDSDFADTTTTTSPSWTEKIQQTVKRIFRSVNLFQTPVNISDANCIRKEYDEASAKLTKIESRLSSLKQKLKHDFGPEKEFYSFHGQCFESKENKYTYKICPFKEATQVEGYSTTRLGNWDKFEDSYRTMQFTNGDHCWNGPNRSVKVKLRCGLKNEVTDIDEPSRCEYLAFLSTPALCLEEKLKELQDKLEMMNREQPQDHDEL

SEQ ID NO: 259 - protein, 358 aa, Citrus trifoliata
MGNFQLKLVSLLFTVCAALSTLSTAQDFKCSAQTAARCQALVGYLPPNKTTISEIQSLFTVKNLRSILGANNFPPGTRRNFSVPAQKPIKVPIPCICSNGTGVSNKLPVYTVKKDDGLDFIARTIFGQLLKYQKIVEANNISNPDLIQIGQNLTIPLPCSCDDVDNAKVVHYAHVVEEGSSFAIIAQKFGTSRDTLMKLNGIDDDSKLIAGEPLDVPLKACNSSIRADSFDSYLRVANGTYTFTANSCVKCQCDATNNWTLQCEPSQFQPSSTHSRWKTCPSMLCGGSESLSIGNATTSNNCNRTTCEYAGYNNLSILTTLNSLSTCPSPSNNASRIGSWNLLLISIFLVLLHFHLIQ

SEQ ID NO: 260 - protein, 415 aa, Citrus clementina
MRINKPKPRLFKLQTSNFKSLLSSSAQEEEQDSRGQPHYQCIYNKKLLTTSQRKVNKMGNFQLKLVLLLFTVCAALSTLSTAQDFKCSTQTAARCQALVGYLPPNKTTISEIQSLFTVKNLRSILGANNFPPGTPRNFSVPAQKPIKVPIHCICSNGTGVSDKVPVYTVKKDDGLDFIARTIFGQLLKYQKIVEANNISNPDLIQIGQNLTIPLPCSCDDVDNAKVVHYAHVVEEGSSFELIAQKFGTDRDTLMKLNGIHDDSKLIAGEPLDVPLKACNSSIKADSFDNYLRVANGTYTFTANSCVKCQCDATNNWTLQCKPSQFQPSSPNSRWKTCPSMLCGDSESLSIGNTTTSNNCNRTTCEYAGYNNLSILTTLNSLSTCPSPSNNASRIGSWNLLLISIFLVLLHFHLIQ

SEQ ID NO: 261 - protein, 425 aa, Citrus clementina
MRINKPKPRLFKLQTSNFKSLLSSSAQEEEQDSRGQPHYQCIYNKKLLTTSQRKVNKMGNFQLKLVLLLFTVCAALSTLSTAQDFKCSTQTAARCQALVGYLPPNKTTISEIQSLFTVKNLRSILGANNFPPGTPRNFSVPAQKPIKVPIHCICSNGTGVSDKVPVYTVKKDDGLDFIARTIFGQLLKYQKIVEANNISNPDLIQIGQNLTIPLPCSCDDVDNAKVVHYAHVVEEGSSFELIAQKFGTDRDTLMKLNGIHDDSKLIAGEPLDVPLKACNSSIKADSFDNYLRVANGTYTFTANSCVKCQCDATNNWTLQCKPSQFQPSSPNSRWKTCPSMLCGDSESLSIGNTTTSNNCNRTTCEYAGYNNLSILTTLNSLSTCPSKFKLSSHPLFCLNALQIYVLIVSLHWNTILSLQVHWHFI

SEQ ID NO: 262 - protein, 358 aa, Citrus sinensis
MGNFQLKLVLLLFTVCAALSTLSTAQDFKCSAQTAARCQALVGYLPPNKTTISEIQSLFTVKNLRSILGANNFPPGTPRNFSVPAQKPIKVPIHCICSNGTGVSDKVPVYTVKKDDGLDFIARTIFGQLLKYQKIVEANNISNPDLIQIGQNLTIPLPCSCDDVDNAKVVHYAHVVEEGSSFALIAQKFGTDRDTLMKLNGIHDDSKLIAGEPLDVPLKACNSSIRADSFDNYLRVANGTYTFTANSCVKCQCDATNNWTLQCEPSQFQPSSPNSRWKTCPSMLCGDSESLSIGNTTTSNNCNRTTCEYAGYNNLSILTTLNSLSTCPSPSNNASRIGSWNLLLISIFLVLLHFHLIQ

SEQ ID NO: 263 - protein, 368 aa, Citrus sinensis
MGNFQLKLVLLLFTVCAALSTLSTAQDFKCSAQTAARCQALVGYLPPNKTTISEIQSLFTVKNLRSILGANNFPPGTPRNFSVPAQKPIKVPIHCICSNGTGVSDKVPVYTVKKDDGLDFIARTIFGQLLKYQKIVEANNISNPDLIQIGQNLTIPLPCSCDDVDNAKVVHYAHVVEEGSSFALIAQKFGTDRDTLMKLNGIHDDSKLIAGEPLDVPLKACNSSIRADSFDNYLRVANGTYTFTANSCVKCQCDATNNWTLQCEPSQFQPSSPNSRWKTCPSMLCGDSESLSIGNTTTSNNCNRTTCEYAGYNNLSILTTLNSLSTCPSKFKLSSHPLFCLNALQIYVLIVSLHWNTILSLQVHWLFI

SEQ ID NO: 264 - protein, 328 aa, Citrus sinensis
MGNFQLKLVLLLFTVCAALSTLSTAQDFKCSAQTAARCQALVGYLPPNKTTISEIQSLFTVKNLRSILGANNFPPGTPRNFSVPAQKPIKVPIHCICSNGTGVSDKVPVYTVKKDDGLDFIARTIFGQLLKYQKIVEANNISNPDLIQIGQNLTIPLPCSCDDVDNAKVVHYAHVVEEGSSFALIAQKFGTDRDTLMKLNGIHDDSKLIAGEPLDVPLKACNSSIKADSFDNYLRVANGTYTFTANSCVKCQCDATNNWTLQCKPSQFQPSSPNSRWKTCPSMLCGDSESLSIGNTTTSNNCNRTTCEYAGYNNLSILTTLNSLSTCP

SEQ ID NO: 265 - protein, 258 aa, Citrus unshiu
TGVSNKVPVYTVKKDDGLDFIARTIFGQLLKYQKIVEANNISNPDLIQIGQNLTIPLPCSCDDVDNAKVVHYAHVVEEGSSFVLIAQKFGTDRDTLMKLNGIHDDSKLIAGEPLDVPLKACNSSIRADSFDNYLRVANGTYTFTANSCVKCQCDATNNWTLQCEPSQFQPSSPNSRWKTCPSMLCGDSESLSIGNTTTSNNCNRTTCEYAGYNNLSILTTLNSLSTCPSPSNNASRIGSWNLLLISIFLVLLHFHLIQ

SEQ ID NO: 266 - protein, 272 aa, Citrus unshiu
MAPSLQFYLPNFIANRVSNKVPVYTVKKDDGLDFIARTIFGQLLKYQKIVEANNISNPDLIQIGQNLTIPLPCSCDDVDNAKVVHYAHVVEEGSSFVLIAQKFGTDRDTLMKLNGIHDDSKLIAGEPLDVPLKACNSSIRADSFDNYLRVANGTYTFTANSCVKCQCDATNNWTLQCEPSQFQPSSPNSRWKTCPSMLCGDSESLSIGNTTTSNNCNRTTCEYAGYNNLSILTTLNSLSTCPSPSNNASRIGSWNLLLISIFLVLLHFHLIQ

SEQ ID NO: 267 - protein, 312 aa, Citrus trifoliata
MACQEEGLLLDEYPKEKFWEILDLYQLDGYWYSGDVIPGMLAFKSEFEALSDDVILASSMKTGTTWLKALCICIMGNQRKNDGDEVDQLEVKNPHDHIKCLEYLYYFNLLSKLKDMQSPRVFNTHLPYSALPELIKNSECKIVYIARNPKDTFVSLWHFFNQILPPNTEPYPLEKAYNSFIKGIHLFGPFHDHVLEYWQESLKNPNKLLFLKYEDLKRDPKGEVRKLASFLGRPFGDDDNDEVDKVLWRSSFERLKNLEVNKNGKLSDSGVPNSSFFRLGNVGDWQNCFTDEMKQGLDEITCKKFEGTGLDL

SEQ ID NO: 268 - protein, 311 aa, Citrus trifoliata
MATASSIPTQELLDQLPKHLHWEAYNIYQWEGFWYPAAVIRGMLAFRSNYKARCDDVILASSLKTGTTWLKALCACIMDYHDDQLSSKNPHLVVKTLEYEFAGETLNPDDLSGMSSPRLFHTHLPYSSLPESIKNSECKIVYITRNPSDTMVSGWHYFNRILRRNNQDPYPFEKEYNNFCAGVHSYGPFFYHVLQYWSGSLKTPSKILFLKYEELKRDPKGQVKRLASFLGRPLAGEDEVDKVIWGSSFERLKNLEVNKNGELPFGNVPNSAFLRLGKVGDWENYFTAEMKQGLDEITRMKLEGSGLDFES

SEQ ID NO: 269 - protein, 312 aa, Citrus sinensis
MACQEEGLLLDEYPKEKFWEILDLYQLDGYWYSGDVIPGMLAFKSEFKALSDDVILASSMKTGTTWLKALCICIMGNQRKNDRDEVDQLEVKNPHDHIKCLEYLYYFNLLSKLKDMQSPRVFNTHLPYSALPESIKNSECKIVYIARNPKDTFVSLWHFFNQILPPNTEPYRLEKAYDSFIKGIHLFGPFHDHVLEYWQESLKNPNKLLFLKYEDLKRDPKGEVRKLASFLGRPFGDEDNDEVDKVLWRSSFERLKNLEVNKNGKLSDSGVPNSSFFRLGNVGDWQNCFTDEMKQGLDEITCKKFEGTGLDL

SEQ ID NO: 270 - protein, 312 aa, Citrus sinensis
MACQEEGLLLDEYPKEKFWEILDLYQLDGYWYSGDVIPGMLAFKSEFEALSDDVILASSMKTGTTWLKALCICIMGNQRKNDGDEVDQLEVKNPHDHIKCLEYFYYFNLLSKLKDMQSPRVFNTHLPYSALPESIKNSECKIVYIARNPKDTFVSLWHFFNQILPPNTEPYRLEKAYDSFIKGIHLFGPFHDHVLEYWQESLKNPNKLLFLKYEDLKRDPKGEVRKLASFLCRPFGDEDNDEVDKVLWRSSFERLKNLEVNKNGKLSDSGVPNSSFFRLGNVGDWQNCFTDEMKQGLDEITCKKFEGSGLDL

SEQ ID NO: 271 - protein, 288 aa, Citrus clementina
MACQEEGLLLDEYPKEKFWEILDLYQLDGYWYSGDVIPGTTWLKALCICIMGNQRKNDRDEVDQLEVKNPHDHIKCLEYLYYFNLLSKLKDMQSPRVFNTHLPYSALPESIKNSECKIVYIARNPKDTFVSLWHFFNQILPPNTEPYRLEKAYDSFIKGIHLFGPFHDHVLEYWQESLKNPNKLLFLKYEDLKRDPKGEVRKLASFLGRPFGDEDNDEVDKVLWRSSFERLKNLEVNKNGKLSDSGVPNSSFFRLGNVGDWQNCFTDEMKQGLDEITCKKFEGTGLDL

SEQ ID NO: 272 - protein, 159 aa, Citrus trifoliata
MSGGIARGRLTEERKAWRKNHPHGFVAKPETKDGSVNLMIWECIIPGKTGTDWEGGYFPLTLYFSEDYPSKPPKCKFPQGFFHPNVYPSGTVCLSILNEDNGWRPAITVKQILVGIQDLLDQPNPADPAQTDGYQLFIQDPAEYKRRVRLQAKQYPPVL

SEQ ID NO: 273 - protein, 160 aa, Citrus trifoliata
MSGGIARGRLAEERKSWRKNHPHGFVAKPETLPDGSVNLMVWHCTIPGKAGTDWEGGFFPLTLHFSEDYPSKPPKCKFPQGFFHPNVYPSGTVCLSILNEDNGWRPAITVKQILVGIQDLLDQPNPADPAQTEGYHLFIQDGAEYKRRVRQQAKQYPALL

SEQ ID NO: 274 - protein, 133 aa, Citrus clementina
MSGGGIARGRLTEERKAWRKNHPHTDWEGGYFPLTLYFSEDYPSKPPKCKFPQGFFHPNVYPSGTVCLSILNEDNGWRPAITVKQILVGIQDLLDQPNPADPAQTDGYQLFIQDPAEYKRRVRQQAKQYPPVL

SEQ ID NO: 275 - protein, 133 aa, Citrus sinensis
MSGGGIARGRLTEERKAWRKNHPHTDWEGGYFPLTLYFSEDYPSKPPKCKFPQGFFHPNVYPSGTVCLSILNEDNGWRPAITVKQILVGIQDLLDQPNPADPAQTDGYQLFIQDPAEYKRRVRQQAKQYPPVI

SEQ ID NO: 276 - protein, 160 aa, Citrus clementina
MSGGGIARGRLTEERKAWRKNHPHGFVAKPETKDGSVNLMIWECIIPGKTGTDWEGGYFPLTLYFSEDYPSKPPKCKFPQGFFHPNVYPSGTVCLSILNEDNGWRPAITVKQILVGIQDLLDQPNPADPAQTDGYQLFIQDPAEYKRRVRQQAKQYPPVL

SEQ ID NO: 277 - protein, 160 aa, Citrus sinensis
MSGGGIARGRLTEERKAWRKNHPHGFVAKPETKDGSVNLMIWECIIPGKTGTDWEGGYFPLTLYFSEDYPSKPPKCKFPQGFFHPNVYPSGTVCLSILNEDNGWRPAITVKQILVGIQDLLDQPNPADPAQTDGYQLFIQDPAEYKRRVRQQAKQYPPVI

SEQ ID NO: 278 - protein, 159 aa, Citrus sinensis
MSGGIARGRLTEERKAWRKNHPHGFVAKPETKDGSVNLMIWECIIPGKTGTDWEGGYFPLTLYFSEDYPSKPPKCKFPQGFFHPNVYPSGTVCLSILNEDNGWRPAITVKQILVGIQDLLDQPNPADPAQTDGYQLFIQDPAEYKRRVRQQAKQYPPVI

SEQ ID NO: 279 - protein, 160 aa, Citrus clementina
MSGGIARGRLAEERKSWRKNHPHGFVAKPETLPDGSVNLMVWHCTIPGKAGTDWEGGFFPLTLHFSEDYPSKPPKCKFPQGFFHPNVYPSGTVCLSILNEDNGWRPAITVKQILVGIQDLLDQPNPADPAQTEGYHLFIQDAAEYKRRVRQQAKQYPALL

SEQ ID NO: 280 - protein, 121 aa, Citrus clementina
MIWECIIPGKTGTDWEGGYFPLTLYFSEDYPSKPPKCKFPQGFFHPNVYPSGTVCLSILNEDNGWRPAITVKQILVGIQDLLDQPNPADPAQTDGYQLFIQDPAEYKRRVRQQAKQYPPVL

SEQ ID NO: 281 - protein, 121 aa, Citrus sinensis
MIWECIIPGKTGTDWEGGYFPLTLYFSEDYPSKPPKCKFPQGFFHPNVYPSGTVCLSILNEDNGWRPAITVKQILVGIQDLLDQPNPADPAQTDGYQLFIQDPAEYKRRVRQQAKQYPPVI

SEQ ID NO: 282 - protein, 140 aa, Citrus clementina
MSGGGIARGRLTEERKAWRKNHPHGFVAKPETKDGSVNLMIWECIIPGKTGTDWEGGYFPLTLYFSEDYPSKPPKCKFPQGFFHPNVYPSGTVCLSILNEDNGWRPAITVKQILVGIQDLLDQPNPADPAQTDGYQLFIQ

SEQ ID NO: 283 - protein, 146 aa, Citrus sinensis
MSGGGIARGRLTEERKAWRKNHPHGFVAKPETKDGSVNLMIWECIIPGKTGTDWEGGYFPLTLYFSEDYPSKPPKCKFPQGFFHPNVYPSGTVCLSILNEDNGWRPAITVKQILVGIQDLLDQPNPADPAQTDGYQLFIQVLYWFI

SEQ ID NO: 284 - protein, 139 aa, Citrus sinensis
MSGGIARGRLTEERKAWRKNHPHGFVAKPETKDGSVNLMIWECIIPGKTGTDWEGGYFPLTLYFSEDYPSKPPKCKFPQGFFHPNVYPSGTVCLSILNEDNGWRPAITVKQILVGIQDLLDQPNPADPAQTDGYQLFIQ

SEQ ID NO: 285 - protein, 121 aa, Citrus clementina
MVWHCTIPGKAGTDWEGGFFPLTLHFSEDYPSKPPKCKFPQGFFHPNVYPSGTVCLSILNEDNGWRPAITVKQILVGIQDLLDQPNPADPAQTEGYHLFIQDAAEYKRRVRQQAKQYPALL

SEQ ID NO: 286 - protein, 134 aa, Citrus sinensis
MSGGGIARGRLTEERKAWRKNHPHGFVAKPETKDGSVNLMIWECIIPGKTGTDWEGGYFPLTLYFSEDYPSKPPKCKFPQGFFHPNVYPSGTVCLSILNEDNVSSSCRFVIYFQIMYGSGLAKISSLDDMMAFF

SEQ ID NO: 287 - protein, 114 aa, Citrus unshiu
MSGGIARGRLAEERKSWRKNHPHDSIYASFSLGVLHFCHFEVNAVRSSSNQFAGMLGWRPAITVKQILVGIQDLLDQPNPADPAQTEGYHLFIQDAAEYKRRVRQQAKQYPALL

SEQ ID NO: 288 - protein, 81 aa, Citrus unshiu
MSGGIARGRLTEERKAWRKNHPHGWRPAITVKQILVGIQDLLDQPNPADPAQTDGYQLFIQDPAEYKRRVRQQAKQYPPVL

SEQ ID NO: 289 - protein, 1048 aa, Citrus trifoliata
MAASNSIEPRLFLNPIFTTSTTTNSPTSLHIQNFKLKLPRFPTKNPTLVFTLNSSSGSATTNNNNNDNTIINPYPDDPDPVRVSAVSSENRARDGRDRRKIVKVAWEKLVRWSRTWRSKAKTDILERTNKVVVLGGGSFGTAMAAHLANRKAQLKVYMLMRDPVVCQSINDKHCNCRYFPEQELPENVIATTDAKTALLGADYCLHAVPVQFSSSFLEGISDYVDPGLPFISLSKGLELNTLRMMSQIIPQALRNPRQPFIALSGPSFALELMNKLPTAMVVASKDRKLANAVQQLLASKHLRISTSSDVTGVEIAGALKNVLAIAAGIVVGMNLGNNSMAALVAQGCSEIRWLATKMGAKPTTITGLSGTGDIMLTCFVNLSRNRTVGVRLGSGEKLDDILSSMNQVAEGVSTAGAVIALAQKYNVKMPVLTAVARIMDNELTPKKAVLELMSLPQLFAQPLNSQTISKKKKRNDKMSKKKETVKEILASCCFSSLGLDSTLCDQLRERLGFEAPTKVQAQAIPVILSGRDVLVNAATGTGKTVAYLAPIINHLQSYSPRIDRSSGTFALVLVPTSELCLLVYEILQKLLHRFRWIVPGYVMGGGNRSKEKARLRKGISILVATPGHLLDHLKHTSSFLHTHVRWIIFDEADRILELGFGKEIEEILDILGSRNIGSIGEGNEVSNVKRQNLLLSATLNEKVIHLAKISLETPVLIGLDEKKLPEDKSNVHFGSLESDVKEEVEHPNTTPSSSTEDFKLPAQLVHRYVKDIDRSNEDFDAFFNRLRSGSSVTTGSTSLKGALPLCALGTKIKSQDSSPSGFRGTLGTRKRKMGSLFSLPEDFIEGELDPVANKKVSHLAEYVHYTSENITPEVAGEMDKLGLDERYNRALKASQDVTFLLSRSLQDLAAIANVQLENEKLKNELQSYRSYEEKLSRENKTLKGRLNEVSKEKARMVKDLKELQGKHEDLVSQQKEMIDSAFERIMTEVWSIDPGLVVPRVEKWVDKSTILAAIETERESCLLQSGNLQRSSDVPRLLKLMLQLHPAL

SEQ ID NO: 290 - protein, 458 aa, Citrus clementina
MAASNSIEPRLFLNPIFTTSTTTNSSTSLHIQNFKLKLPHFPTKNPTLVFTLNSSSGSATTNNNNDNTIITPYPDDPDPEPVSAVSSETRTRDGRDRRKIVKVAWDKLVRWSRTWRSKAKTDILERTNKVVVLGGGSFGTAMAAHVANRKAQLKVYMLMRDPVVCQSINEKHCNCRYFPEQKLPENVIATTDAKTALLGADYCLHAVPVQFSSSFLEGISDYVDPGLPFISLSKGLELNTLRMMSQIIPQALRNPRQPFIALSGPSFALELMNKLPTAMVVASKDRKLANAVQQLLASKHLRISTSSDVTGVEIAGALKNVLAIAAGIVVGMNLGNNSMAALVAQGCSEIRWLATKMGAKPATITGLSGTGDIMLTCFVNLSRNRTVGVRLGSGEKLDDILSSMNQVAEGVSTAGAVIALAQKYNVKMPVLTAVARIIDNELTPKKAVLELMSLPQVI

SEQ ID NO: 291 - protein, 460 aa, Citrus clementina
MAASNSIEPRLFLNPIFTTSTTTNSSTSLHIQNFKLKLPHFPTKNPTLVFTLNSSSGSATTNNNNDNTIITPYPDDPDPEPVSAVSSETRTRDGRDRRKIVKVAWDKLVRWSRTWRSKAKTDILERTNKVVVLGGGSFGTAMAAHVANRKAQLKVYMLMRDPVVCQSINEKHCNCRYFPEQKLPENVIATTDAKTALLGADYCLHAVPVQFSSSFLEGISDYVDPGLPFISLSKGLELNTLRMMSQIIPQALRNPRQPFIALSGPSFALELMNKLPTAMVVASKDRKLANAVQQLLASKHLRISTSSDVTGVEIAGALKNVLAIAAGIVVGMNLGNNSMAALVAQGCSEIRWLATKMGAKPATITGLSGTGDIMLTCFVNLSRNRTVGVRLGSGEKLDDILSSMNQVAEGVSTAGAVIALAQKYNVKMPVLTAVARIIDNELTPKKAVLELMSLPQVEEV

SEQ ID NO: 292 - protein, 479 aa, Citrus clementina
MKKKIPILTLKSRSFICEQMAASNSIEPRLFLNPIFTTSTTTNSSTSLHIQNFKLKLPHFPTKNPTLVFTLNSSSGSATTNNNNDNTIITPYPDDPDPEPVSAVSSETRTRDGRDRRKIVKVAWDKLVRWSRTWRSKAKTDILERTNKVVVLGGGSFGTAMAAHVANRKAQLKVYMLMRDPVVCQSINEKHCNCRYFPEQKLPENVIATTDAKTALLGADYCLHAVPVQFSSSFLEGISDYVDPGLPFISLSKGLELNTLRMMSQIIPQALRNPRQPFIALSGPSFALELMNKLPTAMVVASKDRKLANAVQQLLASKHLRISTSSDVTGVEIAGALKNVLAIAAGIVVGMNLGNNSMAALVAQGCSEIRWLATKMGAKPATITGLSGTGDIMLTCFVNLSRNRTVGVRLGSGEKLDDILSSMNQVAEGVSTAGAVIALAQKYNVKMPVLTAVARIIDNELTPKKAVLELMSLPQVEEV

SEQ ID NO: 293 - protein, 458 aa, Citrus sinensis
MAASNSIEPRLFLNPIFTTSTTTNSSTSLHIQNFKLKLPHFPTKNPTLVFTLNSSSGSATTNNNNDNTIITPYPDDPDPEPVSAVSSEIRTRDGRDRRKIVKVAWEKLVRWSRTWRSKAKTDILERTNKVVVLGGGSFGTAMAAHVANKKSQLKVYMLMRDPAVCQSINEKHCNCRYFPEQKLPENVIATTDAKTALLGADYCLHAMPVQFSSSFLEGISDYVDPGLPFISLSKGLELNTLRMMSQIIPQALRNPRQPFIALSGPSFALELMNKLPTAMVVASKDRKLANAVQQLLASKHLRISTSSDVTGVEIAGALKNVLAIAAGIVVGMNLGNNSMAALVAQGCSEIRWLATKMGAKPATITGLSGTGDIMLTCFVNLSRNRTVGVRLGSGEKLDDILSSMNQVAEGVSTAGAVIALAQKYNVKMPVLTAVARIIDNELTPKKAVLELMSLPQVI

SEQ ID NO: 294 - protein, 460 aa, Citrus sinensis
MAASNSIEPRLFLNPIFTTSTTTNSSTSLHIQNFKLKLPHFPTKNPTLVFTLNSSSGSATTNNNNDNTIITPYPDDPDPEPVSAVSSEIRTRDGRDRRKIVKVAWEKLVRWSRTWRSKAKTDILERTNKVVVLGGGSFGTAMAAHVANKKSQLKVYMLMRDPAVCQSINEKHCNCRYFPEQKLPENVIATTDAKTALLGADYCLHAMPVQFSSSFLEGISDYVDPGLPFISLSKGLELNTLRMMSQIIPQALRNPRQPFIALSGPSFALELMNKLPTAMVVASKDRKLANAVQQLLASKHLRISTSSDVTGVEIAGALKNVLAIAAGIVVGMNLGNNSMAALVAQGCSEIRWLATKMGAKPATITGLSGTGDIMLTCFVNLSRNRTVGVRLGSGEKLDDILSSMNQVAEGVSTAGAVIALAQKYNVKMPVLTAVARIIDNELTPKKAVLELMSLPQVEEV

SEQ ID NO: 295 - protein, 420 aa, Citrus sinensis
MAASNSIEPRLFLNPIFTTSTTTNSSTSLHIQNFKLKLPHFPTKNPTLVFTLNSSSGSATTNNNNDNTIITPYPDDPDPEPVSAVSSEIRTRDGRDRRKIVKVAWEKLVRWSRTWRSKAKTDILERTNKVVVLGGGSFGTAMAAHVANKKSQLKVYMLMRDPAVCQSINEKHCNCRYFPEQKLPENVIATTDAKTALLGADYCLHAMPVQFSSSFLEGISDYVDPGLPFISLSKGLELNTLRMMSQIIPQALRNPRQPFIALSGPSFALELMNKLPTAMVVASKDRKLANAVQQLLASKHLRISTSSDVTGVEIAGALKNVLAIAAGIVVGMNLGNNSMAALVAQGCSEIRWLATKMGAKPATITGLSGTGDIMLTCFVNLSRNRTVGVRLGSGEKLDDILSSMNQVLVNPSMQPLLGKL

SEQ ID NO: 296 - protein, 718 aa, Citrus trifoliata
MERGATTENGHQNGSLGGLCKNNNYNYSSGDALNWGVMAETLKGSHLEEVKRMVAEYRKPVVNLGGETLTVAQVAAIATSSTNVELSESAREGVKASSDWVMESMNKGTDSYGVTTGFGATSHRRTKNGGALQKELIRFLNAGIFGNGTESSHTLPHSATRAAMLVRVNTLLQGYSGIRFEILEAITKLLNHNITPCLPLRGTITASGDLVPLSYIAGLLTGRPNSKATGPNGEIIDAQEASKQAGFGFFELQPKEGLALVNGTAVGSGLASMVLFEANNLALLSEILSAIFAEVMQGKPEFTDHLTHKLKHHPGQIEAAAIMEHILDGSSYVNAAKKLHEIDPLQKPKQDRYALRTSPQWLGPQIEVIRFATKSIEREINSVNDNPLIDVSRNKALHGGNFQGTPIGVSMDNTRLAIAAIGKLMFAQFSELVNDFYNNGLPSNLSGGRNPSLDYGFKGAEIAMASYCSELQFLANPVTNHVQSAEQHNQDVNSLGLISSRKTAEAVDILKLMSSTFLVAICQAIDLRHLEENLKHTVKNTVSQVAKKVLTVGASGELHPSRFCEKDLLKAADHEQVFAYIDDPCSATYPLMQKLRQVLVEHALNNGENEKTANSSIFQKIAAFEEELKTVLPKEVENARQTVENGSPTIPNRIKECRSYPLYRFVREELGSNFLTGEKVTSPGEEFDKVFTAMCQGKIIDPMLECLREWNGAPLPIC

SEQ ID NO: 297 - protein, 721 aa, Citrus trifoliata
MDRGAVIENGHQNGCLEGLCKNNNYSSGDALNWGVMAETLKGSHLEEVKRMVAEYRKPVVNLGGETLTVAQVAAIATAGDVNAQVKVELSESAREGVKASSDWVMESMNKGTDSYGVTTGFGATSHRRTKNGGALQKELIRFLNAGIFGNGTESSHMLPHSATRAAMLVRVNTLLQGYSGIRFEILEAITKLLNHSITPCLPLRGTITASGDLVPLSYIAGLLTGRPNSKATGPNGEIIDAQEASKQAGFGFFELQPKEGLALVNGTAVGSGLASMVLFDANNLALLSEILSAIFAEVMQGKPEFTDHLTHKLKHHPGQIEAAAIMEHILDGSSYVKAAKKLHEIDPLQKPKQDRYALRTSPQWLGPQIEVIRFATKSIEREINSVNDNPLIDVSRNKALHGGNFQGTPIGVSMDNTRLAIAAIGKLMFAQFSELVNDFYNNGLPSNLSGGRNPSLDYGFKGAEIAMASYCSELQFLANPVTNHVQSAEQHNQDVNSLGLISSRKTAEAVDILKLMSSTFLVALCQAIDLRHLEENLKHTVKNTVSQVAKKVLTVGASGELHPSRFCEKDLLKAADREHVFAYIDDPCSATYPLMQKLRQVLVDHALNNGENEKNANSSIFQKIAAFEEELKTVLPKEVENARQTVENGSPTIPNRIKECRSYPLYRLVREELGTNFLTGEKVTSPGEEFDKVFTAMCQGKIIDPMLECLREWNGAPLPIC

SEQ ID NO: 298 - protein, 720 aa, Citrus trifoliata
MELSHETCNGINNDRNGGTPSLGLCTGTDPLNWTVAADSLKGSHLDEVKRMVDEHRRPVVKLGGESLTIGQVTAIAAHDSGVKVELAEAARAGVKASSDWVMDSMMKGTDSYGVTTGFGATSHRRTKQGGALQKELIRFLNSGIFGNGTESSHTLPHSATRAAMLVRVNTLLQGYSGIRFEILETITKFLNHNITPCLPLRGTITASGDLVPLSYIAGLLTGRPNSKAVGPNGQVLNPTEAFNIAGVTSGFFELQPKEGLALVNGTAVGSGLAATVLFEANILAIMSEVLSAIFAEVMNGKPEFTDHLTHKLKHHPGQIEAAAIMEHILDGSSYVKAAQKLHEIDPLQKPKQDRYALRTSPQWLGPQIEVIRAATKMIEREINSVNDNPLIDVSRNKALHGGNFQGTPIGVSMDNTRLAIASIGKLMFAQFSELVNDFYNNGLPSNLTGGRNPSLDYGFKGAEIAMASYCSELQFLANPVTNHVQSAEQHNQDVNSLGLISSRKTAEAVDILKLMSSTFLVALCQAIDLRHLEENLKNTVKNTVSQVAKRVLTMGVNGELHPSRFCEKDLIKVVDREYVFAYIDDPCSASYPLMQKLRQVLVDHALDNGDREKNSTTSIFQKIGAFEDELKTLLPKEVEIARTELESGNAAIPNRIKECRSYPLYKIVREEIGTSLLTGEKVRSPGEEFDKVFVAMCEGKLIDPMLECLKEWNGAPLPIS

SEQ ID NO: 299 - protein, 714 aa, Citrus trifoliata
MEASLENQSGGNIPSGKLCTNIDPLNWVSASESLKGSHLDEVKRMVSEYRKPVIRLGGETLTIAQVAAVASRDVGVTVELNEEARAGVKASSDWVMESINKGTDSYGITTGFGATSHRRTKQGATLQKELIRFLNAGIFGKGTESCQMLPHTATRAAMLVRINSLLQGYSGIRFEILEAITKFLNRNITPCLPLRASITASGDLIHFSYIAGLLTGRPNSVAVGPNGESLNAAEAFSQAGIDGGFFELQPKEGLALVNGTGVGAGLASIVLFEANILTVLSEVLSAIFAEAMQGKPEFTDHLTHKLKHHPGQIEAAAIMEHILAGSSCVKAAQILHEIDPLQKPKQDRYALRTSPQWLGPQAEVIRASTKSIEREINSVNDNPLIDVSRNKALHGGNFQGTPIGVSMDNSRLAIASIGKLMFAQFSELVNDFYSNGLPSNLSGGRNPSLDYGFKGAEIAMAAYCSELQFLANPVTNHVQSAEQHNQDVNSLGLISARKTAEAVDILKLMSSTYLIALCQAIDLRHLEENLKSTVKNTISQVAKKVLTMGVNGELHPSRFCEKDLLKVVDREYVFSYADDPCSATYPLMQKLRQVLVDHALTNNEDLKNANASIFLKIGAFEEELKTLLPKEVESARSAFESGNLEMPNRIKECRSYPLYRFVREQLGARYLTGEKAISPGEECDKVFTAICQGKIIDPLLECLKEWDGSPLPIC

SEQ ID NO: 300 - protein, 718 aa, Citrus clementina
MEIGATTENGHQNGGLEGLCKNNNYNYSSGDALNWGVMAETLKGSHLEEVKRMVAEYRKPVVNLGGETLTVAQVAAIATSSTNVELSESAREGVKASSDWVMESMNKGTDSYGVTTGFGATSHRRTKNGGALQKELIRFLNAGIFGNGTESSHTLPHSATRAAMLVRVNTLLQGYSGIRFEILEAITKLLNHNITPCLPLRGTITASGDLVPLSYIAGLLTGRPNSKATGPNGEIIDAQEASKQAGFGFFELQPKEGLALVNGTAVGSGLASMVLFEANNLALLSEILSAIFAEVMQGKPEFTDHLTHKLKHHPGQIEAAAIMEHILDGSSYVNVAKKLHEIDPLQKPKQDRYALRTSPQWLGPQIEVIRFATKSIEREINSVNDNPLIDVSRNKALHGGNFQGTPIGVSMDNTRLAIAAIGKLMFAQFSELVNDFYNNGLPSNLSGGRNPSLDYGFKGAEIAMASYCSELQFLANPVTNHVQSAEQHNQDVNSLGLISSRKTAEAVDILKLMSSTFLVALCQAIDLRHLEENLKHTVKNTVSQVAKKVLTVGASGELHPSRFCEKDLLKAADREHVFAYIDDPCSATYPLMQKLRQVLVEHALNNGENEKTANSSIFQKIAAFEEELKTVLPKEVENARQTVENGSPTIPNRIKECRSYPLYRFVREGLGSNFLTGEKVTSPGEEFDKVFTAMCQGKIIDPMLECLREWNGAPLPIC

SEQ ID NO: 301 - protein, 718 aa, Citrus sinensis
MERGATTENGHQNGGLEGLCKNNNYNYSSGDALNWGVMAETLKGSHLEEVKRMVAEYRKPVVNLGGETLTVAQVAAIATSSTNVELSESAREGVKASSDWVMESMNKGTDSYGVTTGFGATSHRRTKNGGALQKELIRFLNAGIFGNGTESSHTLPHSATRAAMLVRVNTLLQGYSGIRFEILEAITKLLNHNITPCLPLRGTITASGDLVPLSYIAGLLTGRPNSKATGPNGEIIDAQEASKQAGFGFFELQPKEGLALVNGTAVGSGLASMVLFEANNLALLSEILSAIFAEVMQGKPEFTDHLTHKLKHHPGQIEAAAIMEHILDGSSYVNAAKKLHEIDPLQKPKQDRYALRTSPQWLGPQIEVIRFATKSIEREINSVNDNPLIDVSRNKALHGGNFQGTPIGVSMDNTRLAIAAIGKLMFAQFSELVNDFYNNGLPSNLSGGRNPSLDYGFKGAEIAMASYCSELQFLANPVTNHVQSAEQHNQDVNSLGLISSRKTAEAVDILKLMSSTFLVALCQAIDLRHLEENLKHTVKNTVSQVAKKVLTVGASGELHPSRFCEKDLLKAADREHVFAYIDDPCSATYPLMQKLRQVLVEHALNNGENEKTANSSIFQKIAAFEEELKTVLPKEVENARQTVENGSPTIPNRIKECRSYPLYRLVREELGSNFLTGEKVTSPGEEFDKVFTAMCQGKIIDPMLECLREWNGAPLPIC

SEQ ID NO: 302 - protein, 718 aa, Citrus clementina x Citrus reticulata
MEIGATTENGHQNGGLEGLCKNNNYNYSSGDALNWGVMAETLKGSHLEEVKRMVAEYRKPVVNLGGETLTVAQVAAIATSSTNVELSESAREGVKASSDWVMESMNKGTDSYGVTTGFGATSHRTTKNGGALQKELIKFLNAGIFGNGTKSSHTLPHSATRAAMLVRVNTLLQGYSGIRFEILKAITKLLNHNITPCLPLRGTITASGDLVPLSYIAGLLTGRPNSKATGPNGQIIDPQEASKPAGFGFFELQPKEGLALVNGTAVGSGLASMVLFEANNLALLSEILSAIFAEVMQGKPEFTDHLTHKLKHHPGQIEAAAIMEHILDGSSYVNVAKKLHEIDPLQKPKQDRYALRTSPQWLGPQIEMIRFATKSIEREINSVNDNPLIDVSRNKALHGGNFQGTPIGVSMDNTRLAIAAIGKLMFAQFSELVNDFYNNGLPSNLSGGRNPSLDYGFKGAEIAMASYCSELQFLANPVTNHVHSAEQHNQDVNSLGLISSRKTAEAVDILKLMSSTFLVALCQAIDLRHLEENLKHTVKNTVSQVAKKVLTVGASGELHPSRFCEKDLLKAADREHVFAYIDDPCSATYPLMQKLRQVLVEHALNNGENEKTANSSIFQKIAAFEEELKTVLPKEVENARQTVENGSPTIPNRIKECRSYPLYRLVREGLGSNFLTGEKVTSPGEEFDKVFTAMCQGKIIDPMLECLREWNGAPLPIC

SEQ ID NO: 303 - protein, 721 aa, Citrus trifoliata; identical to SEQ ID NO: 297

SEQ ID NO: 304 - protein, 721 aa, Citrus sinensis
MDRGAVIENGHQNGCLEGLCKDNNYSSGDALNWGVMAETLKGSHLEEVKRMVAEYRKPVVNLGGETLTVAQVAAIATAGDVNAQVKVELSESAREGVKASSDWVMESMNKGTDSYGVTTGFGATSHRRTKNGGALQKELIRFLNAGIFGNGTESSHTLPHSATRAAMLVRVNTLLQGYSGIRFEILDAITKLLNHSITPCLPLRGTITASGDLVPLSYIAGLLTGRPNSKATGPNGEIIDAQEASKQAGFGFFELQPKEGLALVNGTAVGSGLASMVLFDANNLALLSEILSAIFAEVMQGKPEFTDHLTHKLKHHPGQIEAAAIMEHILDGSSYVKAAKKLHEIDPLQKPKQDRYALRTSPQWLGPQIEVIRFATKSIEREINSVNDNPLIDVSRNKALHGGNFQGTPIGVSMDNTRLAIAAIGKLMFAQFSELVNDFYNNGLPSNLSGGRNPSLDYGFKGAEIAMASYCSELQFLANPVTNHVQSAEQHNQDVNSLGLISSRKTAEAVDILKLMSSTFLVALCQAIDLRHLEENLKHTVKDTVSQVARKVLTVGANGELHPSRFCEKDLLKAADREHVFAYIDDPCSATYPLMQKLRQVLVEHALNNGENEKNANSSIFQKIAAFEEELKAVLPKEVENARQTVENGNPTIPNRIKECRSYPLYRLVREELGTNFLTGEKVTSPGEKFDKVFTAMCQGKIIDPMLECLREWNGAPLPIC

SEQ ID NO: 305 - protein, 757 aa, Citrus clementina
MATLGFPLVDLLSFTPIHYSSSWGIFCDCSNIYAKDMDRGAVIENGHQNGCLEGLCKDNNYSSGDALNWGVMAETLKGSHLEEVKRMVAEYRKPVVNLGGETLTVAQVAAIATAGDVNAQVKVELSESAREGVKASSDWVMESMNKGTDSYGVTTGFGATSHRRTKNGGALQKELIRFLNAGIFGNGTESSHTLPHSATRAAMLVRVNTLLQGYSGIRFEILDAITKLLNHSITPCLPLRGTITASGDLVPLSYIAGLLTGRPNSKATGPNGEIIDAQEASKQAGFGFFELQPKEGLALVNGTAVGSGLASMVLFDANNLALLSEILSAIFAEVMQGKPEFTDHLTHKLKHHPGQIEAAAIMEHILDGSSYVKAAKKLHEIDPLQKPKQDRYALRTSPQWLGPQIEVIRFATKSIEREINSVNDNPLIDVSRNKALHGGNFQGTPIGVSMDNTRLAIAAIGKLMFAQFSELVNDFYNNGLPSNLSGGRNPSLDYGFKGAEIAMASYCSELQFLANPVTNHVQSAEQHNQDVNSLGLISSRKTAEAVDILKLMSSTFLVALCQAIDLRHLEENLKHTVKDTVSQVARKVLTVGANGELHPSRFCEKDLLKAADREHVFAYIDDPCSATYPLMQKLRQVLVEHALNNGENEKNANSSIFQKIAAFEEELKAVLPKEVENARQTVENGNPTIPNRIKECRSYPLYRLVREELGTNFLTGEKVTSPGEKFDKVFTAMCQGKIIDPMLECLREWNGAPLPIC

SEQ ID NO: 306 - protein, 721 aa, Citrus clementina x Citrus reticulata
MDRGAVIENGHQNGCLEGLCKDNNYSSGDALNWGVMAETLKGSHLEEVKRMVAEYRKPVVNLGGETLTVAQVAAIATAGDVNAQVKVELSESAREGVKASSDWVMDSMNKGTDSYGVTTGFGATSHRRTQNGGALQKELIKFLNAGIFGNGTKSSHTLPHSATRAAMLVRVNTLLQGYSGIRFEILDAITKLLNHSITPCLPLRGTITASGDLVPLSYIAGLLTGRPNSKATGPNGEIIDAQEASKQAGFGFFELQPKEGLALVNGTAVGSGLASMVLFDANNLALLSEILSAIFAEVMQGKPEFTDHLTHKLKHHPGQIEAAAIMEHILDGSSYVKAAKKLHEIDPLQKPKQDRYALRTSPQWLGPQIEVIRFATKSIEREINSVNDNPLIDVSRNKALHGGNFQGTPIGVSMDNTRLAIAAIGKLMFAQFSELVNDFYNNGLPSNLSGGRNPSLDYGFKGAEIAMASYCSELQFLANPVTNHVQSAEQHNQDVNSLGLISSRKTAEAVDILKLMSSTFLVALCQAIDLRHLEENLKHTVKDTVSQVARKVLTVGANGELHPSRFCEKDLLKAADREHVFAYIDDPCSATYPLMQKLRQVLVEHALNNGENEKNANSSIFQKIAAFEEELKAVLPKEVENARQTVENGNPTIPNRIKECRSYPLYRLVREELGTNFLTGEKVTSPGEKFDKVFTAMCQGKIIDPMLECLREWNGAPLPIC

SEQ ID NO: 307 - protein, 721 aa, Citrus reticulata
MDRGAVIENGHQNGCLEGLCKDNNYSSGDALNWGVMAETLKGSHLEEVKRMVAEYRKPVVNLGGETLTVAQVAAIATAGDVNAQVKVELSESAREGVKASSDWVMESMNKGTDSYGVTTGFGATSHRRTKNGGALQKELIRYVFFYIFGNGTESSHTLPHSATRAAMLVRVNTLLQGYSGIRFEILDAITKLLNHSITPCLPLRGTITASGDLVPLSYIAGLLTGRPNSKATGPNGEIIDAQEASKQAGFGFFELQPKEGLALVNGTAVGSGLASMVLFDANNLALLSEILSAIFAEVMQGKPEFTDHLTHKLKHHPGQIEAAAIMEHILDGSSYVKAAKKLHEIDPLQKPKQDRYALRTSPQWLGPQIEVIRFATKSIEREINSVNDNPLIDVSRNKALHGGNFQGTPIGVSMDNTRLAIAAIGKLMFAQFSELVNDFYNNGLPSNLSGGRNPSLDYGFKGAEIAMASYCSELQFLANPVTNHVQSAEQHNQDVNSLGLISSRKTAEAVDILKLMSSTFLVALCQAIDLRHLEENLKHTVKDTVSQVARKVLTVGANGELHPSRFCEKDLLKAADREHVFAYIDDPCSATYPLMQKLRQVLVEHALNNGENEKNANSSIFQKIAAFEEELKAVLPKEVENAGQTVENGNPTIPNRIKECRSYPLYRLVREELGTNFLTGEKVTSPGEKFDKVFTAMCQGKIIDPMLECLREWNGAPLPIC

SEQ ID NO: 308 - protein, 722 aa, Citrus clementina
MELSHETCNGINNDRNGGTSSLGLCTGTDPLNWTVAADSLKGSHLDEVKRMVDEYRRPVVKLGGESLTIGQVTAIAAHDSGVKVELAEAARAGVKASSDWVMDSMMKGTDSYGVTTGFGATSHRRTKQGGALQKELIRFLNSGIFGNGTESSHTLPHSATRAAMLVRVNTLLQGYSGIRFEILETITKFLNHNITPCLPLRGTITASGDLVPLSYIAGLLTGRPNSKAVGPNGQVLNPTEAFNLAGVTSGFFELQPKEGLALVNGTAVGSGLAATVLFEANILAIMSEVLSAIFAEVMNGKPEFTDHLTHKLKHHPGQIEAAAIMEHILDGSSYVKAAQKLHEIDPLQKPKQDRYALRTSPQWLGPQIEVIRAATKMIEREINSVNDNPLIDVSRNKALHGGNFQGTPIGVSMDNTRLAIASIGKLLFAQFSELVNDFYNNGLPSNLTGGRNPSLDYGFKGAEIAMASYCSELQFLANPVTNHVQSAEQHNQDVNSLGLISSRKTAEAVDILKLMSSTFLVALCQAIDLRHLEENLKNTVKNTVSQVAKRVLTMGVNGELHPSRFCEKDLIKVVDREYVFAYIDDPCSASYPLMQKLRQVLVDHALDNGDREKNSTTSIFQKIGAFEDELKTLLPKEVEIARTELESGNAAIANRIKECRSYPLYKIVREEIGTSLLTGEKVRSPGEEFDKVFAAMCEGKLIDPMLECLKEWNGAPLPICQN

SEQ ID NO: 309 - protein, 722 aa, Citrus sinensis
MELSHETCNGIKNDRNGGTSSLGLCTGTDPLNWTVAADSLKGSHLDEVKRMIDEYRRPVVKLGGESLTIGQVTAIAAHDSGVKVELAEAARAGVKASSDWVMDSMMKGTDSYGVTTGFGATSHRRTKQGGALQKELIRFLNSGIFGNGTESSHTLPHSATRAAMLVRVNTLLQGYSGIRFEILETITKFLNHNITPCLPLRGTITASGDLVPLSYIAGLLTGRPNSKAVGPNGQVLNPTEAFNLAGVTSGFFELQPKEGLALVNGTAVGSGLAATVLFEANILAIMSEVLSAIFAEVMNGKPEFTDHLTHKLKHHPGQIEAAAIMEHILDGSSYVKAAQKLHEIDPLQKPKQDRYALRTSPQWLGPQIEVIRAATKMIEREINSVNDNPLIDVSRNKALHGGNFQGTPIGVSMDNTRLAIASIGKLLFAQFSELVNDFYNNGLPSNLTGGRNPSLDYGFKGAEIAMASYCSELQFLANPVTNHVQSAEQHNQDVNSLGLISSRKTAEAVDILKLMSSTFLVALCQAIDLRHLEENLKNTVKNTVSQVAKRVLTMGVNGELHPSRFCEKDLIKVVDREYVFAYIDDPCSASYPLMQKLRQVLVDHALDNGDREKNSTTSIFQKIGAFEDELKTLLPKEVEIARTELESGNAAIANRIKECRSYPLYKIVREEIGTSLLTGEKVRSPGEEFDKVFAAMCEGKLIDPMLECLKEWNGAPLPICQN

SEQ ID NO: 310 - protein, 722 aa, Citrus limon
MELSHETCNGIKNDRNGGTSSLGLCTGTDPLNWTVAADSLKGSHLDEVKRMIDEYRRPVVKLGGESLTIGQVTAIAAHDSGVKVELAEAARAGVKASSDWVMDSMMKGTDSYGVTTGFGATSHRRTKQGGALQKELIRFLNSGIFGNGTESSHTLPHSATRAAMLVRVNTLLQGYSGIRFEILETITKFLNHNITPCLPLRGTITASGDLVPLSYIAGLLTGRPNSKAVGSNGQVLNPTEAFNLAGVTSGFFELQPKEGLALVNGTAVGSGLAATVLFEANILAIMSEVLSAIFAEVMNGKPEFTDHLTHKLKHHPGQIEAAAIMEHILDGSSYVKAAQKLHETDPLQKPKQDRYALRTSPQWLGPQIEVIRAATKMIEREINSVNDNPLIDVSRNKALHGGNFQGTPIGVSMDNTRLAIASIGKLMFAQFSELVNDFYNNGLPSNLTGGRNPSLDYGFKGAEIAMASYCSELQFLANPVTNHVQSAEQHNQDVNSLGLNSSRKTAEAVDILKLMSSTFLVALCQAIDLRHLEENLKNTVKNTVSQVAKRVLTMGVNGELHPSRFCEKDLIKVVDREYVFAYIDDPCSASSPLMQKLRQVLVDHALDNGDREKNSTTSIFQKIGAFEDELKTLLPKEVEIARTELESGNAAIPNRIKECRSYPLYKIVREDIGTSLLTGEKVRSPGEEFDKVFTAMCEGKLIDPMLECLKEWNGAPLPICQN

SEQ ID NO: 311 - protein, 714 aa, Citrus clementina
MEASHENQSGGNIPSGKLCTNIDPLNWVSASESLKGSHLDEVKRMVSEYRKPVVRLGGETLTIAQVAAVASRDDGVTVELNEEARAGVKASSDWVMESMNNGTDSYGVTTGFGATSHRRTKQGAALQKELIRFLNAGIFGKGTESCHMLPHTATRAAMLVRINTLLQGYSGIRFEILEAITKFLNRNITPCLPLRASITASGDLVPFSYIAGLLTGRPNSVAVGPNGESLNAAEAFSQAGIDGGFFELQPKEGLALVNGTGVGAGLASIVLFEANILTVLSEVLSAIFAEAMHGKPEFTDHLTHKLKHHPGQIEAAAIMEHILDGSSYVKAAQKLHEIDPLQKPKQDRYALRTSPQWLGPQAEVIRASTKSIEREINSVNDNPLIDVSRNKALHGGNFQGTPIGVSMDNSRLAIASIGKLMFAQFSELVNDFYSNGLPSNLSGGRNPCLDYGFKGAEIAMAAYCSELQFLANPVTNHVQSAEQHNQDVNSLGLISARKTAEAVDILKLMSSTYLIALCQAIDLRHLEENLKSTVKSTISQVAKKVLTMGVNGELHPSRFCEKDLLKVVDREYVFSYADDPCSATYPLMQKLRQVLVDHALTNNEDLKNANASIFLKIGAFEEELKTLLPKEVESARSAFESGNLEIPNRIKECRSYPLYRFVREELGARYLTGEKAISPGEECDKVFTAICQGKIIDPLLECLKEWDGSPLPIC

SEQ ID NO: 312 - protein, 714 aa, Citrus clementina
MEASHENQSGGNIPSGKLCTNIDPLNWVSASESLKGSHLDEVKRMVSEYRKPVVRLGGETLTIAQVAAVASRDDGVTVELNEEARAGVKASSDWVMESMNNGTDSYGVTTGFGATSHRRTKQGAALQKELIRFLNAGIFGKGTESCHMLPHTATRAAMLVRINTLLQGYSGIRFEILEAITKFLNRKITPCLPLRASITASGDLVPFSYIAGLLTGRPNSVAVGPNGESLNAAEAFSQAGIDGGFFELQPKEGLALVNGTGVGAGLASIVLFEANILTVLSEVLSAIFAEAMQGKPEFTDHLTHKLKHHPGQIEAAAIMEHILDGSSYVEAAQKFHEIDPLQKPKQDRYALRTSPQWLGPQAEVIRASTKSIEREINSVNDNPLIDVSRNKALHGGNFQGTPIGVSMDNSRLAIASIGKLMFAQFSELVNDFYSNGLPSNLSGGRNPCLDYGFKGAEIAMAAYCSELQFLANPVTNHVQSAEQHNQDVNSLGLISARKTAEAVDILKLMSSTYLIALCQAIDLRHLEENLKSTVKNTISQVAKKVLTMGVNGELHPSRFCEKDLLKVVDREYVFSYADDPCSATYPLMRKLRQVLVDHALTNNEDLKNANASIFLKIGAFEEELKTLLPKEVESARSAFESGNLEIPNRIKECRSYPLYRFVREELGARYLTGEKAISPGEECDKVFTAICQGKIIDPLLECLKEWDGSPLPIC

SEQ ID NO: 313 - protein, 714 aa, Citrus sinensis
MEASHENQSGGNIPSGKLCTNIDPLNWVSASESLKGSHLDEVKRMVSEYRKQVVRLGGETLTIAQVAAVASRDGGVTVELNEEARAGVKASSDWVMESMNKGTDSYGITTGFGATSHRRTKQGAALQKELIRFLNAGIFGKGTESCQMLPHTATRAAMLVRINTLLQGYSGIRFEILEAITKFLNRNITPCLPLRASITASGDLIPFSYIAGLLTGRLNSVAVGPNGESLNAAEAFSQAGIDGGFFELQPKEGLALVNGTGVGAGLASIVLFEANILTVLSEVLSAIFAEAMLGKPEFTDHLTHKLKHHPGQIEAAAIMEHILDGSSYVKAAQKLHEIDPLQKPKQDRYALRTSPQWLGPQAEVIRASTKSIEREINSVNDNPLIDVSRNKALHGGNFQGTPIGVSMDNSRLAIASIGKLMFAQFSELVNDFYSNGLPSNLSGGRNPSLDYGFKGAEIAMAAYCSELQFLANPVTNHVQSAEQHNQDVNSLGLISARKTAEAVDILKLMSSTYLIALCQAIDLRHLEENLKSTVKNTISQVVKKVLTMGVNGELHPSRFCEKDLLKVVDREYVFSYADDPCSATYPLMQKLRQVLVDHALTNNEDLKNANASIFLKIGAFEEELKTLLPKEVESARSAFESGNLEIPNRIKECRSYPLYRFVREELGARYLTGEKAISPGEECDKVFTAICQGKIIDPLLECLKEWDGSPLPIC

SEQ ID NO: 314 - protein, 555 aa, Citrus sinensis
MLVRVNTLLQGYSGIRFEILEAITKLLNHSITPCLPLRGTITASGDLVPLSYIAGLLTGRPNSKATGPNGETIDAQEASKQAGFGFFELQPKEGLALVNGTAVGSGLASMVLFDANNLALLSEILSAIFAEVMQGKPEFTDHLTHKLKHHPGQIEAAAIMEHILDGSSYVKAAKKLHEIDPLQKPKQDRYALRTSPQWLGPQIEVIRFATKSIEREINSVNDNPLIDVSRNKALHGGNFQGTPIGVSMDNTRLAIAAIGKLMFAQFSELVNDFYNNGLPSNLSGGRNPSLDYGFKGAEIAMASYCSELQFLANPVTNHVQSAEQHNQDVNSLGLISSRKTAEAVDILKLMSSTFLVALCQAIDLRHLEENLKHTVKDTVSQVARKVLTVGANGELHPSRFCEKDLLKAADREHVFAYIDDPCSATYPLMQKLRQVLVEHALNNGENEKNANSSIFQKIAAFEEELKAVLPKEVENARQTVENGNPTIPNRIKECRSYPLYRLVREELGTNFLTGEKVTSPGEEFDKVFTAMCQGKIIDPMLECLWEWNGAPLPIC

SEQ ID NO: 315 - protein, 752 aa, Citrus unshiu
MEPKEGLALVNGTGVGAGLASIVLFEANILTVLSEVLSAIFAEAMHGKPEFTDHLTHKLKHHPGQIEAAAIMEHILDGSSYVEAAQKFHEIDPLQKPKQDRGGNIPSGKLCTNIDPLNWVSASESLKGSHLDEVKRMRVPEAGGEARRRDPDDSSGGAVARVSRDGGVTVELNEEARAGVKASSDWVMESMNKGTDSYGITTGFGATSHRRTKQGAALQKELIRFLNAGIFGKGTESCQMLPHTATRAAMLVRINTLLQGYSGIRFEILEAITKFLNRNITPCLPLRASITASGDLIPFSYIAGLLTGRLNSVAVGPNGESLNAAEAFSQAGIDGGFFELQPKEGLALVNGTGVGAGLASIVLFEANILTVLSEVLSAIFAEAMLGKPEFTDHLTHKLKHHPGQIEAAAIMEHILDGSSYVKAAQKLHEIDPLQKPKQDRYALRTSPQWLGPQAEVIRASTKSIEREINSVNDNPLIDVSRNKALHGGNFQGTPIGVSMDNSRLAIASIGKLMFAQFSELVNDFYSNGLPSNLSGGRNPSLDYGFKGAEIAMAAYCSELQFLANPVTNHVQSAEQHNQDVNSLGLISARKTAEAVDILKLMSSTYLIALCQAIDLRHLEENLKSTVKNTISQVVKKVLTMGVNGELHPSRFCEKDLLKVVDREYVFSYADDPCSATYPLMQKLRQVLVDHALTNNEDLKNANASIFLKWIKECRSYHCIGWGSVSDRSEGDYHQARNVIRCLQRFVGKILIQ

SEQ ID NO: 316 - protein, 331 aa, Citrus trifoliata
MEAGQATSSSSWLENSSVSSDRRRAIEELIKGQEMALQLRNLIHKSTKSGEGSKGMIINQDLVANILSSFTNSLSILKNGDSDEASQVQEHTQLSSPCWEAYLKTEDSGESSKSSTVKDRRGCYKRRKCAESWTEHSSTLTDDGFAWRKYGQKVILNAKFPRNYFRCTHKFDQGCLASKQVQKIQEEPPVHRTTYYGRHTCKSLIKSSQLMLDSTTSDQCPMISFGSAHITENDFNPFSSSFPSIKQESNKDDQAPLSDMTRNQSSSSDEYIVSPDFPAFESNEHMKVLSADHGDVISGVNSSCTASAHSLDLAVDMSVNFDDVLEFNFDA

SEQ ID NO: 317 - protein, 356 aa, Citrus clementina
MLLTYLKASICLFSFATPTWKKRGKKIIMKMEAGQATSSSSWLENSSDRRRAIEELIKGQEMALQLRNLIHKSTKSGEGSKAMIINQDLVANILSSFTNSLSILKNGDSDEASQVQEHTQLSSPCWEAYLKTEDSGESSKSSTVKDRRGCYKRRKCAESWTEHSSTLTDDGHAWRKYGQKVILNARFPRNYFRCTHKFDQGCQASKQVQRIQEEPPLHRTTYYGRHTCKSLIKSSQLMLDSTTSDQCPMISFGSAHITEKDFNPFLSSFPSIKQESNKDDQGPLSDMTHNQSSSSDEYLVSHDFPAFESNEHMKVLSSDHGDVISGVNSSCTASAHSLDLAVDMSVNFDDVLEFNF

SEQ ID NO: 318 - protein, 356 aa, Citrus unshiu
MLLTYLKASICLFSFATPTWKKRGKKIIMKMEAGQATSSSSWLENSSDRRRAIEELIKGQEMALQLRNLIHKSTKSGEGSKAMIINQDLVANILSSFTNSLSILKNGDSDEASQVQEHTQLSSPCWEAYLKTEDSGESSKSSTVKDRRGCYKRRKCAESWTEHSSTLTDDGHAWRKYGQKVILNARFPRNYFRCTHKFDQGCQASKQVQRIQEEPPLYRTTYYGRHTCKSLIKSSQLMLDSTTSDQCPMISFGSAHITEKDFNPFLSSFPSIKQESNKDDQAPLSDMTHNQSSSSDEYLVSHDFPAFESNEHMKVLSSDHGDVISGVNSSCTASAHSLDLAVDMSVNFDDVLEFNF

SEQ ID NO: 319 - protein, 328 aa, Citrus clementina
MKMEAGQATSSSSWLENSSDRRRAIEELIKGQEMALQLRNLIHKSTKSGEGSKAMIINQDLVANILSSFTNSLSILKNGDSDEASQVQEHTQLSSPCWEAYLKTEDSGESSKSSTVKDRRGCYKRRKCAESWTEHSSTLTDDGHAWRKYGQKVILNARFPRNYFRCTHKFDQGCQASKQVQRIQEEPPLHRTTYYGRHTCKSLIKSSQLMLDSTTSDQCPMISFGSAHITEKDFNPFLSSFPSIKQESNKDDQGPLSDMTHNQSSSSDEYLVSHDFPAFESNEHMKVLSSDHGDVISGVNSSCTASAHSLDLAVDMSVNFDDVLEFNF

SEQ ID NO: 320 - protein, 328 aa, Citrus sinensis
MKMEAGQATSSSSWLENSSDRRRAIEELIKGQEMALQLRNLIHTSTKKGEGSKAMIINQDLVANILSSFTNSLSILKNGDSDEASQVQEHTQLSSPCWEAYLKTEDSGESSKSSTVKDRRGCYKRRKCAESWTEHSSTLTDDGHAWRKYGQKVILNARFPRNYFRCTHKFDQGCQASKQVQRIQEEPPLHRTTYYGRHTCKSLIKSSQLMLDSTTSDQCPMISFGSAHITEKDFNPFLSSFPSIKQESNKDDQGPLSDMTHNQSSSSDEYLVSHDFPAFESNEHMKVLSSDHGDVISGVNSSCTASAHSLDLAVDMSVNFDDVLEFNF

SEQ ID NO: 321 - protein, 330 aa, Citrus maxima
MKMEAGQATSSSSWLENSSDRRRAIEELIKGQEMALQLRNLIHTSTKKGEGSKAMIINQDLVANILSSFTNSLSILKNGDSDEASQVQEHTQLSSPCWEAYLKTEDSGESSKSSTVKDRRGCYKRRKCAESWTEHSSTLTDDGHAWRKYGQKVILNARFPRNYFRCTHKFDQGCQASKQVQRIQEEPPVYRTTYYGRHTCKSLIKSSQLMLDSTTSDQCPMISFGSAHITEKEFNPFLSSFPSKKQESNKDDQAPLSDMTHNQSSSSDEYLVSPDFPAFESNEHMKVLSSDHGDVISGVNSSCTASAHSLDLAVDMSVNFDDVLEFNFDA

SEQ ID NO: 322 - protein, 328 aa, Citrus japonica
MKMEAGQATSSSSWLENSSDRRRAIEELIKGQEMALQLRNLIHTSTKKGEGSKAMIINQDLVANILSLFTNSLSILKNGDSDEASQVQEHTQLSSPCWEAYLKTEDSGESSKSSTVKDRRGCYKRRKCAESWTEHSSTLTDDGFAWRKYGQKVILNSKFPRNYFRCTHKFDQGCQASKQVQRIQGEPPLYRTTYYGRHTCKSLIKSSQLMPDSTTSDQCPMISFGSAHITEKDFNPFLSSFPSIKQESNKDDQAPLSDMTHNQSSSSDEYLVSHDFPAFESNEHMKVLSSDHGDVISGVNSSCTASAHSLDLAVDMSVNFDDVLEFNF

SEQ ID NO: 323 - protein, 795 aa, Citrus trifoliata
MCSNLYITNKALTACSLSILHEWLFLRVNTWEIPLEIGNLQNLEELSLGLNKLIGTVPVAIFNVSTLKILELGGNSLSGSLSSIADVRLPNLEVLLLWGNNFSGTIPRFIFNASKLSILDLQYNSFSSFIPNTFGNLRNLEGLYLQDNYLTSSTPELSFLSSLSNCKSLTAIGLSNNPLDGILPKTSIGNHSYSLEDLEMHNCNVSGGIPEEIGNLTNLITIDLGGNKLNGSILITLSKLQKLQGLVLDDNKLEGSIPDDICRLVELYKLELGGNKLSGSIPACFSNLIALRILSLGSNELTSIPLTFWNLKDILYLNFSSNCFTGPLPLEIGNLKVLVGIDFSMNNFSGIIPKEIGGLNYLEYLFLGYNRLQGSIPDSFGNLISLKFLNLSNNNLSGAIPASLEKLSYLEDLNLSFNKLEGEIPWGGSFGNFSVESFEGNELLCGSPNLQVPPCKTSIHHTSWKTSLLLGIVLPLSTTLMIVVIWLIWLAHMYRATDGFSENNLIGRGGFGSVYKARLGDGMEVAVKVFNLQCRRAFKSFDVECEIMKSIRHRNLIKVISSCSNEDFKGLVLEYMPQGSLEKHLYSSNCILDIFQRLNIMIDVASALEYLHFGCSTPVIHCDLKPSNVLLDDNMVAYLSDFGIAKLLIGEDQSMTQTQTLATIGYMAPEYGREGRVSTNGDVYSFGIMLMETFTGKKPTDEIFNGEMTLKHWVNDWLPISTMEVVDANLLSQEDVHFVAKEQCVSFVFNLAMACTVESHEQRINAKEIVTKLLKIRDSLLRNVGGIRIRQPNLN

SEQ ID NO: 324 - protein, 685 aa, Citrus clementina
MLREHAVAGEQAEDMLQVLGVPTAGLEDTCQDLGGGERGVGPNLPDGIRYMETDGSGEIPLEIGNLQNLEVLDLGQNKLIGTVPAAIFNVSTLKFIELQDNSLSGSLSSITDVRLPNLEKLHLWELSFLSSLSNCKSLTLIDLSNNPLDGILPKTSIGNLSHSLKDFKMHNCNVSGGIPEEISRLTNLTTIDLGGNKLNGSIPITLSKLQKLQGLGLEDNKLEGSIPDSICRLTELYDLELGGNKLFGSIPACFSNLASLRILSLGSNELTSIPLTFWNLNDILYLNFSSKFFTAPLPLEIGNLKVLVGMDFSMNNFSGVIPTKIGGLNNLEYLFLGYNKLQGSILDSFGDLISLKSLNLSNNNLSGAIPASLEKLSYLEDLNLSFNKLEGEILMGGSFGNFSAESFEGNELLCGSPNLQVPPCKTSIHRTSWKNSLLLGIVLPLSTIFMIVVILLGDEMEVAVKVFNLQCGRAFKSFDVECEIMKSIRHRNLIKVISSCSNEELNIMIDVASALEYLHFGHSAPIIHCDLKPSNVLLDDNMVAHLSDFSITKLLTREDQSMTQTQTFATIVYMAPEYGREGRVSANGDVYSFGDYVNGNFYWGRTHRWRGGSGAMTLKQWVVDVNLLSQEDVHFVAKEQCVSFVFNLAMACTVESPEQRINAKEIVTMLLKIRGSLLRNCDLNY

SEQ ID NO: 325 - protein, 924 aa, Citrus unshiu
MIFSKLDRATARSSPRAGPPLLRMMSRFLLLHCLILISLFIAAATANTSSTITDRDALLALKAHITHDPTNFLAKNWNTSTPVCNWTGVVCDVHSHRVTVLNISSLNLTGTIPSQLGNLSSLQSLNLSCNRLSGSIPSAIFTIYTLKYVSFRENQVSGQIPANICSNLPFLDYLSLAKNMFHGGIPSALSNCTYLQILHLSYNDFSGAVPKDIGNLSKLKELYLGRNRLQGEIPREFGNLTELEQMSLSENELQEHAVAGEQAEDMLQVLGVPTAGLEDTCQDLGGGERGVGPNLPDGIRYMETDGSGEIPLEIGNLQNLEVLDLGQNKLIGTVPAAIFNVSTLKFIELQDNSLSGSLSSITDVRLPNLEKLHLWELSFLSSLSNCKSLTLIDLSNNPLDGILPKTSIGNLSHSLKDFKMHNCNVSGGIPEEISRLTNLTTIDLGGNKLNGSIPITLSKLQKLQGLGLEDNKLEGSIPDSICRLTELYDLELGGNKLFGSIPACFSNLASLRILSLGSNELTSIPLTFWNLNDILYLNFSSNFFTAPLPLEIGNLKVLVGMDFSMNNFSGVIPTKIGGLKNLEYLFLGYNKLQGSILDSFGDLISLKSLNLSNNNLSGAIPASLEKLSYLEDLNLSFNKLEGEILMGGSFGNFSAESFEGNELLCGSPNLQVPPCKTSIHRTSWKNSLLLGIVLPLSTIFMIVARLGDEMEVAVKVFNLQCGRAFKSFDVECEIMKSIRHRNLIKVISSCSNEELNIMIDVASALEYLHFGHSAPIIHCDLKPSNVLLDDNMVAHLSDFSIAKLLTGEDQSMTQTQTFATIGYMAPEYGREGRVSANGDVYSFGIMLMETFTGKKPTDEIFNEEMTLKQWEDVHFVAKEQCVSFVFNLAMACTVESPEQRINAKEIVTKLLKIRGSLLRNVGGR

SEQ ID NO: 326 - protein, 694 aa, Citrus unshiu
MIFSKLDRATARSSPRAGPPLLRMMSRFLLLHCLILISLFIAAATANTSSTITDRDALLALKAHITHDPTNFLAKNWNTSTPVCNWTGVVCDVHSHRVTVLNISSLNLTGTIPSQLGNLSSLQSLNLSCNRLSGSIPSAIFTIYTLKYVSFRENQVSGQIPANICSNLPFLDYLSLAKNMFHGGIPSALSNCTYLQILHLSYNDFSGAVPKDIGNLSKLKELYLGRNRLQGEIPREFGNLTELEQMSLSENELQGEIPLEIGNLQNLEVLDLGQNKLIGTVPAAIFNVSTLKFIELQDNSLSGSLSSITDVRLPNLEKLHLWEFSKNSFSGFIPNTFGNLRNLQKLRLYDNYLTSLTPELSFLSSLSNCKSLTLIDLSNNPLDGILPKTSIGNLSHSLKDFKMHNCNVSGGIPEEISRLTNLTTIDLGGNKLNGSIPITLSKLQKLQGLGLEDNKLEGSIPDSICRLTELYDLELGGNKLFGSIPACFSNLASLRILSLGSNELTSIPLTFWNLNDILYLNFSSNFFTAPLPLEIGNLKVLVGMDFSMNNFSGVIPTKIGGLKNLEYLFLGYNKLQGSILDSFGDLISLKSLNLSNNNLSGAIPASLEKLSYLEDLNLSFNKLEGEILMGGSFGNFSAESFEGNELLCGSPNLQVPPCKTSIHRTSWKNSLLLGIVLPLSTIFMIVVILLILRY

SEQ ID NO: 327 - protein, 768 aa, Citrus unshiu
MIFSKLDRATARSSPRAGPPLLRMMSRFLLLHCLILISLFIAAATANTSSTITDRDALLALKAHITHDPTNFLAKNWNTSTPVCNWTGVVCDVHSHRVTVLNISSLNLTGTIPSQLGNLSSLQSLNLSCNRLSGSIPSAIFTIYTLKYVSFRENQVSGQIPANICSNLPFLDYLSLAKNMFHGGIPSALSNCTYLQILHLSYNDFSGAVPKDIGNLSKLKELYLGRNRLQGEIPREFGNLTELEQMSLSENELQEHAVAGEQAEDMLQVLGVPTAGLEDTCQDLGGGERGVGPNLPDGIRYMETDGSGEIPLEIGNLQNLEVLDLGQNKLIGTVPAAIFNVSTLKFIELQDNSLSGSLSSITDVRLPNLEKLHLWGNNFSGTIPRFIFNASKLSILEFSKNSFSGFIPNTFGNLRNLQKLRLYDNYLTSLTPELSFLSSLSNCKSLTLIDLSNNPLDGILPKTSIGNLSHSLKDFKMHNCNVSGGIPEEISRLTNLTTIDLGGNKLNGSIPITLSKLQKLQGLGLEDNKLEGSIPDSICRLTELYDLELGGNKLFGSIPACFSNLASLRILSLGSNELTSIPLTFWNLNDILYLNFSSNFFTAPLPLEIGNLKVLVGMDFSMNNFSGVIPTKIGGLKNLEYLFLGYNKLQGSILDSFGDLISLKSLNLSNNNLSGAIPASLEKLSYLEDLNLSFNKLEGEILMGGSFGNFSAESFEGNELLCGSPNLQVPPCKTSIHRTSWKNSLLLGIVLPLSTIFMIVVILLILRY

SEQ ID NO: 328 - protein, 680 aa, Citrus unshiu
MCSNLYITNKALTVCSLPILHEWLFFCVREIPPEIGNLRNLEELDLGHNKLVGTVPAAIFNLSTLKEFSIPNNSLSGCLSSIADVRLPNLEVLNFWELSFLSSLSNCKSLTYIDLSYNPLDSILPRTSVGNLSHSLEDFEMNNCNVSGGIPEEISNLTNLTTIDLGGNKLNGLIPITLSKLQKLQGLVLYDNKLEGSIPDDICRLAELYELELDGNKLSGSIPACLSNLISLRILSLGSNELTSIPLTFWNLEDILYLNFSSNFLTGPLPLEIGKLKVLVGIDFSMNNFSGVIPTKIGGLKNLEYLFLGYNRLQGSIPDSFGDLTSLKSLNLSNNNLSGTIPASLEKLSYLENLNLSFNKLEGEIPRGGSFGKFSAESFKGNELLCGSPNLQVPPCKTSIHHTSWKNSLLLGIVLPLTRLGDGMEVAVKVFNLECGRAFKSFDVECDMMKSIRHRNLIKVISSCSNEELNIMIDVASALEYLHFGYSAPVIHCDLKPSNVLLDDNMVAHLSDFSIAKLLTGEDQSMTQTQTLATIGYMAPEYGREGRVSANGDVYSFGIMLMETFTGKKPTDEIFNEEMTLKHWEDIHFVAKEQCVSFVFNLAMACTVESPEQRINAKEIVTKLLKIRDSLLRNVGGRFSLVLSRFIEVSSFLFGKGKCYLLLTDYEYFNLTCETVLSAI

SEQ ID NO: 329 - protein, 885 aa, Citrus unshiu
MERAHSLMMMSRFLLLHCLILISLFIAAATANTSSTITDQDALLALKAHITHDPTNFLAKNWNTSTPVCNWTGVACEVHSQRVTVLNISSLNLTGTIPSQLGNLSSLQSLNLSFNRLFGSIPSAIFTTYTLKYVCLRGNQLSGTFPSFISNKSSLQHLDLSSNALSGEIRANICSNLPFLEYLAFFKNMLHGGIPSTLSNCTYLRTLDFSYNDFSEAIPKDIGNLTNLKELYLGRNRLQGEIPREFGNLPELELMSLAANNLQGKIPLKIGNLRNLEKLDIGDNKLVGIAPIAIFNVSTLKILGLQDNSLSGCLSSIGYARLPNLEILSLWELSFLSSLSNCKFLKYFDLSYNPLYRILPRTIVGNLSHSLEEFKMSNCNISGGIPEEISNLTNLRTIYLGGNKLNGSILITLSKLQKLQDLGLKDNKLEGSIPYDICNLAELYRLDLDGNKLSGSIPACFSNLTSLRIVSLGSNELTSIPLTFWNLKDILNLNFSSNFLTGSLPLEIGSLKVLVGIDLSRNNFSGVIPTEIGGLKNLEYLFLGYNRLQGSIPNSFGDLISLKFLNLSNNNLSGVIPASLEKLSYLEDLNLSFNQLEGKIPRGGSFGNFSAQSFEGNELLCGSPNLQIPPCKTSIHHKSWKKSILLGIVLPLSTTFMIVASLGDGMEVAVKVFTSQCGRAFKSFDVECEIMKSIRHRNLIKVISSCSNEELNIMIDVASALEYLHFGYSAPVIHCDLKPSNVLLDDNMVAHLSDFSIAKMLTGEDQSMIQTQTLATIGYMAPEYGREGRVSANGDVYSFGIMLMETFTGKKPTDEIFNGEMTLKHWEDIHFVAKEQCVSFVFNLAMECTMEFPKQRINAKEIVTKLLKIRDSLLRNVGGRCVMKF

SEQ ID NO: 330 - protein, 862 aa, Citrus unshiu
TTANTITITIDQDALLALKAHITHDPTNFLAKNWNTSTPVCNWTGVTCDVHSHRVTVLNISRLNLTGTIPSQLGNLSSLQSLNLSFNRFFGSIPSAIFTIYTLKYVSFRENQLSGTFPSLILNKSSLQHLDFTHNTLSGEIPANICSNLPFLEYFSLFQNMFHGGIPSTLSNCTYLRILSLSSNDFSGPIPKEIGNLTKLKELYLGRNRLHGEIPQEFGNLVKLELMSLPENKLQGEIPSEIGNFHNLEYLDLSLNKLVGVVPSAIFNVSTLKYLGLQNNSLSGSLSSILDFRLPNLEELHLWELSFLSSLSNCKSLRLIDLSNNSLDGILPRTSVGNLSHSLEYFDMSYCNVSGGIPEEINNLTNLITIYLAGNKLNGSIPITLSKLQKLQGLGLQDNKLKGLIPEDICRLAKLYELNLGGNMLSGSIPACFSNLASLRTLSLGFNELTSIPSTFWNLKDILYLNFSSNFFAGPLPLKIGNLKVLIEIDFSMNNFSGVIPTTIGGLKNLQYLSLGNNRLQGSIPNSVGDLISLKSLNLSNNNLSGAIPVSLEKLTYLKDLDLSFNKLEGEIPNGGSFGNFSAESFEGNQLLCGLPNLHVPPCKTSIHHTSWKNALLLGTFLPVSTIFMIVVIIEDGMDVAVKVFNLEYGRAFKSFDVECEIMKSIRHRNLIKVISSCSNEELNIMIDVALALEYLHFGCSASVIHCDLKPSNVLLDDNMVAHLSDFGIAKLLTGEDQSMIQTQTLATIGYMAPEYGREGRVSANGDVYSFGIMLMETFTGKKPTDKIFNGEMTLTHWEDVHFAAKEQCMSFVFNLAMECTAESPEQRINAKEIVTRLLKIKDSLLRNVGGLITLCNNSWGV

SEQ ID NO: 331 - protein, 901 aa, Citrus unshiu
MERVHSLSMISRFLLLHCLVLIFLFIAAATANTSTITTDQDALLALKAHISHDPTNFLAKNWNKSTPICNWTGVTCDVHSHRVTVLNISSLNLTGTVPAQLGNLSSLQSLDLSFNRLSGFIPSTIFTMYTLKRVSFRENQLSGTFPSFIFNKSSLQHLDFSHNTLSGEIPANICSNLPFLEYISLSQNMFHGRIPPTLSNCTYLRILGLSLNNFSGAIPKEISYLTKLKELYLGVNRLQGEIPREVGNLAELELMSLPENKLQGEIPQELGNLVGLEFLFLSDNFLTGTIPKEISNFTNLQDLGLDSNRLQGEIPPEIGNLRSLEWLLLGYNKLVGTIPAAIFNVSTLKQLDLQNNSLSGSLSSIADVRLPNLEMIYMWELSFLSSLSNCKSLTHIRLSDNPLNGILPRTTVGNLSHSLELFDMSYCNISGSIPKEISNLTNLTTIYLVGNKLNGLIPITLGKLQKLQSLVLEDNKLKGSIPDDICRLAELYELNLGGNKLSGSIPACFSNLASLRTLSLSSNELTSIPLTLWNLKDILYLNFSSNFLSGPLPLEIENLKVLVGIDFSMNNFSSVIPTTIGSLKDLQYLLLAYNKLQGSIPDSVGDLISLKSLNLSNNNLSGAIPVSLEKVSYLENLDLSFNKLEGEIPKGGSFGNFSAESFEGNELLCGSPNLQVPPCKISIHHASRKNALLLGTALPLTRIQDGIEVAVKVFNLQCGRAFKSFDVECQVMKSIRHRNLIKVISSCSNEELNIMIDVASALEYLHFGYSTPVIHCDLKPNNVLLDNNMVAHLSDFGIAKLLTGEDQFVTQTQTLATIGYMAPEYGREGRVSTNGDVYSFGIMLMETFTGKKPTDKIFNGEMTLKRWVVDANLLSREDIHFVAKEQCLSFVFNLAMDCTVE

SEQ ID NO: 332 - protein, 694 aa, Citrus unshiu
ATANTSTITADQDALLSLKAHITHDPTNFLAKNWNTSISFCNWTGVTCDVHSHRVTILNISGLNLTGTIPSQLGNLSSLQSLNLSFNQLSGSIPSAIFTTYTLTYVSLCQNQLSGKIPANICSNLPFLEFLSLSKNMLYGGIPSTLSNCTYLRILRAIPKEIGNLTKLKELSLGGNRLQGEIPREFGNLADLEQMSLWENNLRGEIPLEIGNLQNLEELDLRQNKLVGIVPASIFNVSTLKLLQLQNNSLLGCLSSIADVRLPNLEELSLWELVGNSFSGFIPNTFGNLRNLERLNLQDNYLTSSTPELSFLSSLSNCKSLTLIALSNNPLDGNLRKTSVGNLSHSLEIFLMYNCNISGGISEEISNLTNLTTINLGGNKLNGSIPIALGKLQKLQYLGLEDNKLEGSIPDDICRLDELYELELGGNKLSGSIPACFGNLIALRILSLGSNELTSIPLTFWNLKDILQLNFSSNYFTGPLPLEIGNLKVLIGIDFSMNNFSGVIPTEIGGLKNLEYLFLGYNRLRGSIPDSFGDLISLKFLNLSNNNLSGAIPASLEKLSYLEDLNLSFNKLEGEIPRGGSFGNFSAESFEGNELLCGSSNLQVPPCKTRIHHTSWKKSLLLGIVLPLSTTLMIVVIWLILRYRQRGKQPSNDANMPLVATWRTFSYLELCQATDEFSENNLIGRGGFGSFISP

SEQ ID NO: 333 - protein, 420 aa, Citrus clementina
GNKLSGSLPACFSNLTSLRIVSLGSNKLTSVPLTFWNLKDILNLNFSSNFLTSPLPLEIGNLKVLIGIDFSMNNFSGVIPTEIGGLKNLEYLFLGYNRLQGSIPDSFGDLISLKFLNLSNNNLSGAIPASLEKLSYLENLNLSFNKLEGEIPRGGSFGNFSAESFEGNELLCGSPNLQVPPCKTSIHHTSWKNSLLLRIVLPLSTTFMIVVILLILRYQQRGKLKVFNLQCGRAFESFDVECEMMKNIRHRNLIKVISSCSNEELNIMIDVASALEYLHFEYQSMTQTQTLATIGYMAPEYGREGRVSANGDVYSFGIMLMETFTGKKPTDEIFNGEMTLKHWVNDWLLISTMEVVDANLLSQEDIHFVAKEQCVSFVFNLAMACTVESPEQRINAKEIVKKLLKIRDSLLRNVGGRFCF

SEQ ID NO: 334 - protein, 775 aa, Citrus unshiu
MCSNLYITNKALTVCSLPILHEWLFFCVREIPPEIGNLRNLEELDLGHNKLVGTVPAAIFNLSTLKEFSIPNNSLSGCLSSIADVRLPNLEVLNFWGNNFSGTIPRFIFNASKLSALDLDGNSFSGFIPNTFGNLRNLKWLILSDNYLTSSTPELSFLSSLSNCKSLTYIDLSYNPLDSILPRTSVGNLSHSLEDFEMNNCNVSGGIPEEISNLTNLTTIDLGGNKLNGLIPITLSKLQKLQGLVLYDNKLEGSIPDDICRLAELYELELDGNKLSGSIPACLSNLISLRILSLGSNELTSIPLTFWNLEDILYLNFSSNFLTGPLPLEIGKLKVLVGIDFSMNNFSGVIPTKIGGLKNLEYLFLGYNRLQGSIPDSFGDLTSLKSLNLSNNNLSGTIPASLEKLSYLENLNLSFNKLEGEIPRGGSFGKFSAESFKGNELLCGSPNLQVPPCKTSIHHTSWKNSLLLGIVLPLSTTFMIVVILLILRYRQRGKQPSNDANMPLVFNLECGRAFKSFDVECDMMKSIRHRNLIKVISSCSNEELNIMIDVASALEYLHFGYSAPVIHCDLKPSNVLLDDNMVAHLSDFSIAKLLTGEDQSMTQTQTLATIGYMAPEYGREGRVSANGDVYSFGIMLMETFTGKKPTDEIFNEEMTLKHWVNDWLPISTMEVVDVNLLSQEDIHFVAKEQCVSFVFNLAMACTVESPEQRINAKEIVTKLLKIRDSLLRNVGGRFSLVLSRFIEVSSFLFGKGKCYLLLTDYEYFNLTCETVLSAI

SEQ ID NO: 335 - protein, 839 aa, Citrus clementina
MYTLKYVNFRGNQLSGAFPSFIFNKSSLQDLDFSYNALSGEIPANICSNLPFLESISLSQNMFHGGIPSTLSNCKYLEILSLSINNLLGAIPKEIGNLTKLKELYLGYSGLQGEIPREFGNLAELELMALQVSNLQGEIPQELANLTGLEVLKLDKIFLTGEIPPEIHNLHNLKLLDLSHNKLVGAVPATIFNMSTLTGLGLQSNSLSGSLSSIADVQLPNLEELRLWSNNFSGTIPRVIFNASKLSVLELGINSFSGFIPNTFGNLRNLSFLSSFSNCKSLTYIGLSNNPLDGILPRMSMGNLSHSLEYFDLSYCNVSGGFPEEIGNLTNLIGIYLRGNKLNGSIPITLGKLQKLQGLHLEDNKLEGPIPDDICRLTKLYELGLSGNKLSGSIPACFSNLASLGTLSLGSNKLTSIPLTIWNLKSMLYLNFSSNFFTGPLPLDIGNLKVLIGIDFSTNNFSDVIPTVIGGLTNLQYLFLGYNRLQGSISESFGDLISLKSLNLSNNNLSRSIPISLEKLSYLEDLDLSFNKLKGEIPKGGSFGNFSAKSFEGNELLCGSPNLQVPPCKTSIHHKSRKNVLLLGIVLPLSTIFIIVVILLIVRYRKRVAVKVFDLQCGRAFKSFDVECEIMKSIRHRNLIKVISSCSTEELNIMVDVATALEYLHFGYSAPVIHCDLKPNNVLLDDNMVAHLSDFGIAKLLIGEDQSMTQTQTLATIGYMAPDVYSFGIILMETFKGKKPTDEIFNEEMTLKHWVNDWLPISIMKVIDANLLSREDMHFVAKEQCVSFVFNLAMECTVESPQQRINAKKIVTRLLKIRDSLLRNVGATSLLYYRPNCFY

SEQ ID NO: 336 - protein, 611 aa, Citrus clementina
MNSFSGFIPSTFGNLRNLEWLTLYDNNLTSSTLDLSFLSSLSNCKSLTHISLSNNPLDGILPRTYVGNLSHSLKNFYMYNCNVSGGIPEEITNLTDLTTIVLGGNKLNGSIPITLGKLQKLQDVDLEYNQLEGSIPDSICLSVELYELELGGNKLSGSIPACFSNMTFLKVLSLGSNELTSIPLNFWSLKDILDLNLSSNCFSGPLPLEIRNLKALIEIDFSMNNFSGIIPMEIGSLKNLENLFLEYNRLEGSIPDSFGDLISLKSLNLSYNNLSGTIPVSLEKLSYLKDLNLSFNKLKGEIPRGGSFGNFSAESFKGNELLCGSPNLQVPPCKASIHRTSRKNALILGIVLPFSTIFMTAIILFIIKYQKREKGPPNDPNMPPVFNLQCGRAFKSFDVECAMMKSIRHRNLVKVISSCSNEELNIMIDVASALEYLHFGYSAPVIHCDLKPSNVLLDDNMVAHLSDFGIAKLLTGEDQSMTQTQTLATIGYMAPEYGREGQVSTNGDVYSFGIMLMETFTRKKPTDELFNGEMTLKHWVNDCLPISTMEVVDANLLSQEDIHFVAKEQCVSFVFNLALECTVESPEQRINAKEIVAKLLKIRDSLLRNVY

SEQ ID NO: 337 - protein, 1024 aa, Citrus unshiu
MERVHSLSMISRFLLLHCLVLIFLFIAAATANTSTITTDQDALLALKAHISHDPTNFLAKNWNKSTPICNWTGVTCDVHSHRVTVLNISSLNLTGTVPAQLGNLSSLQSLDLSFNRLSGFIPSTIFTMYTLKRVSFRENQLSGTFPSFIFNKSSLQHLDFSHNTLSGEIPANICSNLPFLEYISLSQNMFHGRIPPTLSNCTYLRILGLSLNNFSGAIPKEISYLTKLKELYLGVNRLQGEIPREVGNLAELELMSLPENKLQGEIPQELGNLVGLEFLFLSDNFLTGTIPKEISNFTNLQDLGLDSNRLQGEIPPEIGNLRSLEWLLLGYNKLVGTIPAAIFNVSTLKQLDLQNNSLSGSLSSIADVRLPNLEMIYMWGNNFSGTIPRFIFNASKLSILSLEKNSFSGFIPNTFGNLRNLEQLDLSDNYLTSSTPELSFLSSLSNCKSLTHIRLSDNPLNGILPRTTVGNLSHSLELFDMSYCNISGSIPKEISNLTNLTTIYLVGNKLNGLIPITLGKLQKLQSLVLEDNKLKGSIPDDICRLAELYELNLGGNKLSGSIPACFSNLASLRTLSLSSNELTSIPLTLWNLKDILYLNFSSNFLSGPLPLEIENLKVLVGIDFSMNNFSSVIPTTIGSLKDLQYLLLAYNKLQGSIPDSVGDLISLKSLNLSNNNLSGAIPVSLEKVSYLENLDLSFNKLEGEIPKGGSFGNFSAESFEGNELLCGSPNLQVPPCKISIHHASRKNALLLGTALPLSTIFMIVVILLILKCRKRRKRPSDDANIPPVFNLQCGRAFKSFDVECQVMKSIRHRNLIKVISSCSNEELNIMIDVASALEYLHFGYSTPVIHCDLKPNNVLLDNNMVAHLSDFGIAKLLTGEDQFVTQTQTLATIGYMAPEYGREGRVSTNGDVYSFGIMLMETFTGKKPTDKIFNGEMTLKRWICDWIPISIMEVVDANLLSREDIHFVAKEQCLSFVFNLAMDCTVECPEQRINAKEIVTRLLKIRDSLLRNVEGRCIRQSNLN

SEQ ID NO: 338 - protein, 590 aa, Citrus clementina
MSTLTGLGLQSNSLSGSLSSIADVQLPNLEELRLWSNNFSGTIPRVIFNASKLSVLELGINSFSGFIPNTFGNLRNLRLLTLHYNYLTSSNLELSFLSSFSNCKSLTYIGLSNNPLDGILPRMSMGNLSHSLEYFDLSYCNVSGGFPEEIGNLTNLIGIYLRGNKLNGSIPITLGKLQKLQGLHLEDNKLEGPIPDDICRLTKLYELGLSGNKLSGSIPACFSNLASLGTLSLGSNKLTSIPLTIWNLKSMLYLNFSSNFFTGPLPLDIGNLKVLIGIDFSTNNFSDVIPTVIGGLTNLQYLFLGYNRLQGSISESFGDLISLKSLNLSNNNLSRSIPISLEKLSYLEDLDLSFNKLKGEIPKGGSFGNFSAKSFEGNELLCGSPNLQVPPCKTSIHHKSRKNVLLLGIVLPLNRFSENNLIGRGGFGSVYKARIGEGMEVAVKVFDLQCGRAFKSFDVECEIMKSIRHRNLIKVISSCSTEEFKALVLEYMPHGSLEKNLYSSNCILDIFQRLNIMVDVATALEYLHFGYSAPVIHCDLKPNNVLLDDNMVAHLSDFGIAKLLIGEDQSMTQTQTLATIGYMAPEYGRE

SEQ ID NO: 339 - protein, 621 aa, Citrus clementina
MSNCNVSGGIPEEISNLTHLTTIILGGNKLNGSIPITLGKLQKLQGLGLGDNKLEGSIPDDICRLAELYRLELGGNKLYGSIPTCFGNLASLRILSLGSNKLTSIPLTFWNLKDILQLNFSSNFLTGPLPLEIGNLKVLIVIDFSMNNFSGVISTEIGGLKNLEYLFLGYNRLRGSIPDSFGDLISLKSLNLSNNNLSGAIPTSLEKLSYLEDLNLSFNKLEGEIPRGGSFANFSAESFEGNELLCGSPNLQVPPCKTSIHHTSWKNSLLLGIVLPLSTTLLIVVIWLILRYRQRGKQPSNDANMSLVATWRKFSYLELCRATDGFSENNLIGRGGFGSVYKARLGNGMEVAVKVFNLQCGRAFKSFDVECEMMKSIRHRNLIKVISSCSNEEFKALVLEYMPHGSLEKYLYSSNCILDIFQRLNIMIDVASALEYLHFGCSALVIHCDLKPSNVLLGDNMVAHLSDFGIAKLLIGEDQSMTQTQTLGTIGYMAPEYGREGRVSANGDVYSFGIMLMETFTGKKPTDEIFNGEMTLKHWVNELLPISTMEVVDANLLRQEDIHFAAKEQCVSFIFNLAMACTVESPEQRINAKEIVKKLLKIRDSLLRNVGGICIRQSNLN

SEQ ID NO: 340 - protein, 1024 aa, Citrus sinensis
MERLHSLRMMSRFLLLHCLILISLFIAAATANTSSTITDRDALLALKAHITHDPTNFLAKNWNTSTPVCNWTGVACDVHSHRVTVLNISSLNLTGTIPSQLGNLSSLQSLNLSCNRLFGSIPSAIFTIYTLKYVSLRENQVSGQIPANICSNLPFLDYLSLGKNMFHGGIPSALSNCTYLQILHLSYNDFSGAVPKDIGNLSKLKELYLGRNRLQGEIPREFVNLTELERMSLSENELQGGIPRELGNLTKLEGLQLFRNNLTGGIPRELGNLTKLERLQLFWNNLTGAIPKEIGNLTKLKELSLDGNRLQGEIPLEISNLQNLEELDLRHNKLVGTVPAAIFNMSMLKLLHLQNNSLLGCLSSIADVRLPNLEALLLWDNPLDGILSKTSIGNLSHSLKDFYMSNCNVSGGIPEEITNLTNSITIDLGGNKLNGSIPITLSKLQKLQGLGLDDNKLEGSIPDSICRLTELYELELGGNKLFGSIPACFSNLASLRILSLSSNELTSIPLTFWNLKDILQLNFSSNFLTGPLPLEIGNLKVLIGIDFSMNNFSSVIPTEIGGLKNLEYLFLGYNRLEGSIPDSFGDLISLKFLNLSNNNLSGAIPTSLEKLSYLEDLNLSFNKLEGEIPRGGSFGNFAAESFEGNELLCGSPTLQVLPCKTSIHHTSWKNSLLLGIVLPLSTTLLIVVIWLILRYRKRGKQPSNDANMPLVATWRTFSYLELCRATNGFSENNLIGRGGFGSVYKARLGDGMEVAVKVFNLQCGRAFKSFAVECEMMKSIRHRNLIKVISSCSNEEFKALVLEYKPHGSLEKYLYSSNCILDIFQRLNIMIDVASALEYLHFGCSAPVIHCDLKPDNVLLDDNLVAYLSDFGIAKLLIGEDQSMTQTQTLATIGYMAPEYGREGRVSTNGDVYSFGIMLMETFTGKKPTDEIFNGEMTLKHWVNDWLPISTMEVVDANLLSQEDVHFVAKEQCVSFVFNLAMACTVESHEQRINAKEIVTKLLKIRDSLLRNVGGRRISQPNLN

SEQ ID NO: 341 - protein, 585 aa, Citrus sinensis
EIPLEIGNLQNLEELDLRQNKLIGTVPVAIFNVSTLKLLGLQDNSLSGSLSSITDVRLPNLEELVLWGNNFSELNFLSSLSNCKSLTVIGLSNNPLDGILPKTSIGNLSHSLEDFQMHNCNVTGDIPEEIGNLTNLITIDLGGNKLNGSILITLSKLQKLQGLVLDDNKLEGSIPDDICRLVELYKLELGGNKLSRSIPACFNNLIALRILSLGSNDPLPLEIGNLKVLVGIDFSMNNFSGIIPKEIGGLKNLEYLFLGYNRLQGLIPDSFGNLISLKFLNLSNNNLSGAIPASLEKLSYLEDLNLSFNKLEGEIPRGGSFGNFSAESFEGNELLCGSPNLQVPPCKTSIHHPSWNISLLLGIVLPLSTTLMIVVIWLILRYRQRGKQPSNDANMPLVAMWRTFSYLELCRATDGFSENNLIGRGGFGSVYKARLGDGMEVAVKVFNLQCRRAFKSFDVECEIMKSIRHRNLIKVISSCSNEEFKGLVLEYMPQGSLEKHLYSTNCILDIFQRLNIMIDVASALEYLHFGCSTPVIHCDLKPSNVLLDDNMIAYLSDFGIAKLLIGEDQSMTQTQTLATIGYMAP

SEQ ID NO: 342 - protein, 1070 aa, Citrus clementina
MSRFLLLHCLILISLFIAAAAANTSSTITDRDGLLALKAHITHDPTNFLAKNWNTSTPVCNWTGVACDVHSHRVTVLNISSLNLTGTIPSQLGNLSSLQSLNLSFNRLSGSIPSAIFTMYTLKNVSFHENQLSGQIPANICSSLPFLEFFSLSKNMFHGGIPSTLSNCTYLRILSLAYNDFSGAVPREIGEIPREFCNLTELEQMSLAGGIPRELGNLTKLERLQLFENNLTGALPKEIGNLTKLKHLSLDHNRLQGEIPREFGNLAELELLSLYENKLQGEIPLEIGNLQNLEELGLGQNKLIGTVPVAIFNVSTLKFLELQDNSLSGSLSSIVDVRLPNLEKLLLWGNNFSGTIPHFIFNASKLSILELSQNSFADFIPNTFGNLRNLQRLKLYDNYLTSSTPELSFLFSLSNCKSLTHLSLSNNPLDGILPRTSVGNLSHSLKEFYMSNCNVSGGIPEEITNLTNLTTIFFGGNKLNGSIPITLGKLQKLQGLGLEDNKLEGSIPDNICRLTELYELELGGNKLSGSIPACFNNLASLRILSLGSNELNSIPLTFWNLKDILQLNCSSNFFTGPLPSEIGNLKVLVGIDFSMNNFSGVIPTEIGGLKNLEYLFLGYNRLQGSIPNSFGDLISLKSLNLSNNNLSGVIPASLEKLSYLEDLNLSFNKLEGEIPTGGSFGNFSAESFEGNELLCGSPNLQVPPCKTSIHRTSWKNSLLLGIVLPLSTTFMMVVILLILRYRQRGKRPSNDASMPLVAMWRTFSYLELCQATDEFSENNLIGKGGFGSVYKARLGDGMEVAVKVFNLQCGRALKSFNVECEMMKSIRHRNLIKVISSCSNEEFKALVLEYMPHGSLEKYLYSSNCILDIFQRLNIMIDVASALEYLHFGYSAPIIHCDLKPSNVLLDDNMVAHLSDFSIAKLLVGEDQSMTQTQTFATIGYMAPEYGREGRVSANGDVYSFGIMLMETFTGKKPTDEIFNGEMTLKHWVNDWLPISTLEVVDANLLSQEDIHFVAKEQCVSFVFNLAMACAVESPEQRINAKEIVKKLLKIRDSLLRNVGGRCIRQSNLN

SEQ ID NO: 343 - protein, 1068 aa, Citrus unshiu
MSRFLLVHYLILISLLIASATANISTITPDRDALLAMKAHITHDPTNFFAKNWNTSISFCNWTGVTCDVHSHRVTVLNISRLNLTGTIPSQLGNLSSLQSLNLSFNRLSGSIPSAIFTTYTLKYVSFRENQLSGAFPSFIYNKSSLQHLDFSFNTLSGEIPASICSNLPFLEYISLSKNMFHGGIPSALSKCTYLRILSLSYNDLSGAVPKDIGNLSKLKELYLGRNRLQGEIPRGFGNLTELELMSLSENELQGGIPQELGNLTKLEMLQLFWNNLTGEIPLEIGNLQNLEELELGQNKLIGTVPVAIFNVSTLKFLEIQNNSLSGSLSSIADVRLPNLEELLLWGNNFSGTIPRFIFNASKLSILDLQDNSFSSFIPNTFGNLRNLEWLNLQDNYLTSSTPELSFLSSLSNCKSLRLIGLSNNPLDGILPKTSVGNLSLSLEDFKMHNCNISGGIPEEISNLTNLITIDLGGNKLNGSILITLSKLQKLQGLDLDDNKLEGSISDDICRLAELYELELDGNKLSGSIPACFSNLIALRILSLGSNELTSIPSTFWNLKDILYLNFSSNFLTGPLPLEIGNLKVLVGIDFSMNNFSGVIPTEIGGLKNLEYLFLGYNRLQGSIPDSFGNLISLKFLNLSNNNLSGAIPASLEKLSYLEDLNLSFNKLEGEIPRGGSFGNFSAESFEGNELLCGSPNLQVPPCKTSIHHTSWKISLLLGIVLPLSATLMIVVIWLILRYRQRGKQPSNDANMPLVATWRTFSYLELCRATNEFSENNLLGRGGFGSVYKARLGDGMEVAVKVFNLQCRRAFKSFNVECEIMKSIRHRNLIKVISSCSNEEFKGLVLEYMPHGSLEKHLYSSNCILDIFQRLNIMIDVASALEYLHFGCSTPVIHCDLKPSNVLLDDNMVAYLSDFGIAKLLIGEDQSMTQTQTLATIGYMAPEYGREGRVSTNGDVYSFGIMLMETFTGKKPTDEIFNGEMTLKHWVNDWLPISTMEVVDANLLSQEDVHFVAKEQCVSFVFNLAMACIVESHEQRINAKEIVTKLLKIRDSLLRNVGGRRIRQPNLN

SEQ ID NO: 344 - protein, 1164 aa, Citrus sinensis
MMSRFLLLHCLIIIFLFISAAAANTSSTITDREALLALKAHITHDPTNFLAKNWNTSTPVCNWTGVTCDVHSHRVTVLNISSLNLTGTIPSQLGNLSSLQSLNLSFNRLSGSIPSAIFTMYTLKNVTFRENQLSGQIPANICSSLPFLEFLSLSQNMFHGGIPSTLSNCTYLRILSLSYNDFSGAVPREIGNSTKLKILYLGRNRLQGEIPREFCNLTELEHMSLAGNNLQGGIPQELGNLAKLEMLQLFQNNLTGAIPKEIGNLTKLKELSLNHNRLQGEIPREFGNLAELELMWLSENNLQGGIPRELGNLTKLEILHLWKNNLTGAIPKEIGNLTKLKELPLYSNRLQGEIPREFGNLAELEMLSLYENKLQGEIPLEISNLQKLEDLGLGQNKLIGIVPVAIFNVSTLKFLELQDNSLSGSLSSIVDVLPNLEKLLLWGNNFSGTIPHFIFNASKLSILELSQNSFAGFIPNTFGNLRNLQRLKLYDNYLTSSTPELSFLFSLSNCKSLTHLSLSNNPLDGILQRTSVGNLSHSLKEFYMSNCNVSGGIPEEITNLTNLTTIFFGGNKLNGSIPITLGKLQKLQGLGLEDNKLEGSIPDNICRLTELYELELGGNKLSGSIPACFNNLASLRILSLGSNELTSIPLTFWNLKDILQLNCSSNFLTGQLPSEIGNLKVLVGIDFSMNNFSGVIPTEIGGLKNLEYLFLGYNRLQGSIPNSFGDLISLKSLNLSNNNLSGAIPASLEKLSYLEDLNLSFNKLEGEIPTGGSFGNFSAESFEGNELLCGSPNLQVSPCKTSIHRTSWKKSLLLGIVLPLSTTFMIVVILLILRYRQRGKRPSNDASMPLVAMWRTFSYLELCRATDEFSENNLIGKGGFGSVYKARLGDGMEVVVKVFNLQCGRAFKSFDVECEMMKSIRHRNLIKVISSCSNEEFKALVLEYMPHGSLEKYLYSSNCILDIFQRLNIMIDVASTLEYLYFGHSAPIIHCDLKPSNVLLDDNMVAHLSDFSIAKLLTGDDQSMTQTQTFATIGYMAPEYGREGRVSANGDVYSFGIMLMETFTGKKPTDEIFNEEMTLKQWVNDWLPISTMEVVDANLLSPEDVHFVAKEQCVSFVFNLAMACTVESPEQRINAKEIVTKLLKIRGSLLRNVGGRCIRQSNLN

SEQ ID NO: 345 - protein, 1077 aa, Citrus sinensis
MEKRHSLSIMSRFLLLRCLILISLFIAAATANTSTITTDRDALLALKAHITHDPTNFFAKNWNTSTPVCNWTGVTCDVHSHRVTVLNISRLNLTGTIPSQLGNLSSLQSLNLSCNRLSGSIPSAIFTTYTLKYVSFRKNQLSGAFPSFAFNTSSLQYLDFGFNTLSGEIPANICSNLPFLEYLALSQNMFHGGIPSALSNCAYLQRLGLSSNDFSGVVPKEICNLTKLKGLYLGGNRLQGEIPRESGNLAELELMSLSENELQGAIPREWGNLTGLGILQLSDNFLTGEIPLEIGNLQNLEELELGQNKLIGTVPVAIFNVSTLRFLDFQDNSLSGSLSSIADVRLLNLQELLLWGNKFSGTIPRFIFNASKLSILDLQDNSFSSFIPNTFGNLRNLQRLRLYDNYLTSSTPELSFLSSLSNCKSLTHLSLSNNPLDGILQRTSVGNLSHSLKEFYMSNCNVSGGIPEEITNLTNLTTIYLGGNKLNGSIPITLGKLQKLQGLGLEDNKLQGSIPDNIFRLTELYELELGGNKLSGSIPACFNNLASLRILSLGSNELTSIPLTFWNLKDILQLNCSSNFLTGPLPSEIGNLKVLVIIDFSMNNFSGVIPTEIGGLKNLEYLFLGYNRLQGSIPNSFGDLISLKSLNLSNNNLSGAIPASLEKLSYLEDLNLSFNKLEGEIPTGGSFGNFSAESFEGNELLYGTPNLQVPPCKTSIHRTSWKNSLLLRIVLPLSTTFMIVVILLILRYRQRGKRPSNDASMPLVAMWRTFSYLELCRATDEFSENNLIGTGGFGSVYKARLGDGMEVAVKVFNLQCGRAFKSFDVECEMMKSIRHRNLIKVISSCSNEEFKALVLEYMPHGSLEKYLYSSNCILDIFQRLNIMIDVASALEYLHFGYSAPIIHCDLKPNNVLLDDNMVAHLSDFSIAKLLAGEDQSMTQTQTFATIGYMAPEYGREGRVSANGDVYSFGIMLMETFTRKKPTDEIFNGEMTLKHWVNDWLPISTMEVVDANLLSQEDIHFVAKEQCVSFVFNLAMACTGESPEQRINAKEIVKKLLKIRDSLLRNVGGRCIRQSNLN

SEQ ID NO: 346 - protein, 1070 aa, Citrus sinensis
MERLHSLRMMSRFLLLHCLILISLFIAAATANTSSTITDRDALLALKAHITHDPTNFLAKNWNTSTPVCNWTGVACDVHSHRVTVLNISSLNLTGTIPSQLGNLSSLQSLNLSCNRLFGSIPSAIFTIYTLKYVSLRENQVSGQIPANICSNLPFLDYLSLGKNMFHGGIPSALSNCTYLQILHLSYNDFSGAVPKDIGNLSKLKELYLGRNRLQGEIPREFVNLTELERMSLSENELQGGIPRELGNLTKLEGLQLFRNNLTGGIPRELGNLTKLERLQLFWNNLTGAIPKEIGNLTKLKELSLDGNRLQGEIPLEISNLQNLEELDLRHNKLVDVRLPNLEALLLWGNNFSGTIPRFIFNASKLSILELSQNSFSGFIPNTFGNLRNLEWLNLRDNYLTSSTPELSFLSSLSNCKSLTFIHLSDNPLDGILSKTSIGNLSHSLKDFYMSNCNVSGGIPEEITNLTNSITIDLGGNKLNGSIPITLSKLQKLQGLGLDDNKLEGSIPDSICRLTELYELELGGNKLFGSIPACFSNLASLRILSLSSNELTSIPLTFWNLKDILQLNFSSNFLTGPLPLEIGNLKVLIGIDFSMNNFSSVIPTEIGGLKNLEYLFLGYNRLEGSIPDSFGDLISLKFLNLSNNNLSGAIPTSLEKLSYLEDLNLSFNKLEGEIPRGGSFGNFAAESFEGNELLCGSPTLQVLPCKTSIHHTSWKNSLLLGIVLPLSTTLLIVVIWLILRYRKRGKQPSNDANMPLVATWRTFSYLELCRATNGFSENNLIGRGGFGSVYKARLGDGMEVAVKVFNLQCGRAFKSFAVECEMMKSIRHRNLIKVISSCSNEEFKALVLEYKPHGSLEKYLYSSNCILDIFQRLNIMIDVASALEYLHFGCSAPVIHCDLKPDNVLLDDNLVAYLSDFGIAKLLIGEDQSMTQTQTLATIGYMAPEYGREGRVSTNGDVYSFGIMLMETFTGKKPTDEIFNGEMTLKHWVNDWLPISTMEVVDANLLSQEDVHFVAKEQCVSFVFNLAMACTVESHEQRINAKEIVTKLLKIRDSLLRNVGGRRISQPNLN

SEQ ID NO: 347 - protein, 1173 aa, Citrus unshiu
MERLHSLSIMSRFLLLNRLLLISLFIAVATANTSTITTDRDALLAMKAHITHDPTNFLAKNWNTSISFCNWTGVTCDVHGHRVTALNISGLNLISTIPFQLGNLSSLQSLNLSCNRLSGSIPSAIFTIYTLKYVSFRENQLSGAFPSFIFNKSSLQHLDFSRNTLSGEIPANICSSLPFLEILSLSKNMFHGGIPSALSNCTYLQILSLSYNDFSGAIPKDIGNLTKLKGLYLGRNSLQGEIPREFGNLSEMELMSLSENKLRGGIPQELGNLTKLEMLQLFLNNLTGAIPKEIGNLTKLKELSLFRNMLQGEIPREFGNLSELELMSLSENELQGEIPREFGNLVELGLLSLYENKLQGAIPRELGNLTGLENLQLDENFLTGEIPLEIGNLQNLKELILADNKLVGTVPTAIFNVSTLKLLALYNNSLSGCLSSIGDDQLPNLEILYLWGNNFNGTIPRFIFNASKLSYLSLGENSFSGFIPNTFGNLRNLERLNFEDNYLTSSTPELSFLSSLSNCKSLTIIHLSNNPLDGILPKTSVSNLSLSFEEFYMYNCNISGGIPEEISNLTNLTTIKLGGNKLNGSIPIALGKLQKLQYLGLEDNKLEGSIPNDICRLAKLYLLELGGNKLYGSIPACFGNLASLRILSLGSNGLTSIPLTFWNLKDILYLNFSSNFFTGPLPLEIGNLKVLVGMDFSMNNLSDVIPTEIGGLKNLEYLFLGYNKLQGSIPDSFGDLISLKFLNLSNNNLSGAIPASLEKLSYLEDLNLSFNKLEGEIPRGGSFGNFSAESFEGNELLCGSPNLQVPPCKTRIHHASWKKSLLLGTILPLSTTFMIVVILLILRYRQRGKRPLNDANMPLVATWRMFSYLELCRATSGFSENNLIGRGGFGSVYKARLGDGIEVAVKVFNLQCERAFKSFDVECEVMKSIRHRNLIKVISSCSNEEFKALVLEYMPHGSLEKYLYSSNCILDIFQRLNIMIDVASALEYLHFGHSAPIIHCDLKPSNVLLDDNMVAHLSDFSIAKLLTGEDQSMTHTQTLATIGYMAPEYGREGRVSANGDVYSFGIMLMETFTGKKPTDEMFNEEMTLKHWVNDWLPISTMEVVDANLLSQEDIHFVAKEQCVSFVFNLAMECTVESPEQRINAKEIVAKLLKIRDLLLRNVGGRCIRQSNLN

SEQ ID NO: 348 - protein, 1149 aa, Citrus sinensis
MERLHSLSIMSRFRLLHCLILISLFIAAATANTSTITTDRDALLALKAHITHDPTNFFAKNWNTSISFCNWTGVTCDVHSHRVTVLNISRLNLTGTIPSQLGNLSSLQSLNLSFNRLSGSIPSAIFTMYTLKYVSFRENQLSGAFPSFIFNKSSLQHLDFSQNTLSGEIPANICSNLPFLEYISLSKNMFHGGIPSALSKCTYLQILSLSFNDFSGAIPKDIGNLTKLMELYLGRNRLQGEIPREFGSLAELELMSLRESNLQGGIPQELGNLAKLEMLQLFQNNLTGAIPKEIGNLTKLEELYLGINRLQGEIPREFSNLAKLEMMSLSENNLQGEIPHELGNLSGLETLALYNNFLTGEIPHEISNLQNLEELDLGHNKLVGTVPAAIFNVSTLKGFSVSNNSLSGCLSSIVDARLPNLEVLYLWGNNFSGTIPRFIFNVSKLSKLSLEKNSFSGFIPNTFGNLRNLKWLILYDNYLTSSTPGLSFLSSLSNCKSLTYIDLSHNPLDSILQRMSIGNLSHSLEEFQMYNCNVSGGIPEEIRNLSNLTLIDLGGNKLNGSIPITLSKLQKLQGLGLENNKLEGSIPDDICRLAELFRLELGGNKLSGSIPTCFSNLASLRILSLGSNELTSIPLTFWNLKDILQLNFSSNFLTGPLPLEIGNLKVLVGIDLSMNNFSGVIPTEIGGLKNLEYLFLGYNRLQGSIPNSFGDLINLKFLNLSNNNLSGAIPASLEKLSYLEDLNLSFNKLEGEIPRGGSFGNFSAESFEGNELLCGSPNLQVPPCKTGIHHTSSKNSLLLGIVLPLSTIFMIVVSLLILRYRQRGKRPSNDANMPLVATWRMVSYLELCRATDGFSENNLIGKGGFGSVYKARLSDGMEVAVKVFNLQCGRAFKSFDIECEMMKSIRHRNLIKVISSCSNEEFKALVLEYMPHGSLEKYLYSSNCILDIFQRLNIMIDVASALEYLHFGHSAPIIHCDLKPSNVLLDDNMVAHLSDFSIAKLLIGEDQSMTHTQTLATIGYMAPEYGREGRVSTNGDVYSFGIMLMETFTEKKPTDEIFNEEMTLKQWVNDWLPISTMEVVDGNLLSQEDIHFVAKEQCVSYVFNLAMACTVESPKQRINAKEIVTKLLKIRGSLLRNVGGRCIRQSNLN

SEQ ID NO: 349 - protein, 1132 aa, Citrus sinensis
MERLHSLSIMSRFRLLHCLILISLFIAAATANTSTITTDRDALLALKAHITHDPTNFFAKNWNTSISFCNWTGVTCDVHSHRVTVLNISRLNLTGTIPSQLGNLSSLQSLNLSFNRLSGSIPSAIFTMYTLKYVSFRENQLSGAFPSFIFNKSSLQHLDFSQNTLSGEIPANICSNLPFLEYISLSKNMFHGGIPSALSKCTYLQILSLSFNDFSGAIPKDIGEIPREFGSLAELELMSLRESNLQGGIPQELGNLAKLEMLQLFQNNLTGAIPKEIGNLTKLEELYLGINRLQGEIPREFSNLAKLEMMSLSENNLQGEIPHELGNLSGLETLALYNNFLTGEIPHEISNLQNLEELDLGHNKLVGTVPAAIFNVSTLKGFSVSNNSLSGCLSSIVDARLPNLEVLYLWGNNFSGTIPRFIFNVSKLSKLSLEKNSFSGFIPNTFGNLRNLKWLILYDNYLTSSTPGLSFLSSLSNCKSLTYIDLSHNPLDSILQRMSIGNLSHSLEEFQMYNCNVSGGIPEEIRNLSNLTLIDLGGNKLNGSIPITLSKLQKLQGLGLENNKLEGSIPDDICRLAELFRLELGGNKLSGSIPTCFSNLASLRILSLGSNELTSIPLTFWNLKDILQLNFSSNFLTGPLPLEIGNLKVLVGIDLSMNNFSGVIPTEIGGLKNLEYLFLGYNRLQGSIPNSFGDLINLKFLNLSNNNLSGAIPASLEKLSYLEDLNLSFNKLEGEIPRGGSFGNFSAESFEGNELLCGSPNLQVPPCKTGIHHTSSKNSLLLGIVLPLSTIFMIVVSLLILRYRQRGKRPSNDANMPLVATWRMVSYLELCRATDGFSENNLIGKGGFGSVYKARLSDGMEVAVKVFNLQCGRAFKSFDIECEMMKSIRHRNLIKVISSCSNEEFKALVLEYMPHGSLEKYLYSSNCILDIFQRLNIMIDVASALEYLHFGHSAPIIHCDLKPSNVLLDDNMVAHLSDFSIAKLLIGEDQSMTHTQTLATIGYMAPEYGREGRVSTNGDVYSFGIMLMETFTEKKPTDEIFNEEMTLKQWVNDWLPISTMEVVDGNLLSQEDIHFVAKEQCVSYVFNLAMACTVESPKQRINAKEIVTKLLKIRGSLLRNVGGRCIRQSNLN

SEQ ID NO: 350 - protein, 812 aa, Citrus unshiu
MCSNLYITNKALTVCSLPILHEWLFFCVREIPPEIGNLRNLEELDLGHNKLVGTVPAAIFNLSTLKEFSIPNNSLSGCLSSIADVRLPNLEVLNFWGNNFSGTIPRFIFNASKLSALDLDGNSFSGFIPNTFGNLRNLKWLILSDNYLTSSTPELSFLSSLSNCKSLTYIDLSYNPLDSILPRTSVGNLSHSLEDFEMNNCNVSGGIPEEISNLTNLTTIDLGGNKLNGLIPITLSKLQKLQGLVLYDNKLEGSIPDDICRLAELYELELDGNKLSGSIPACLSNLISLRILSLGSNELTSIPLTFWNLEDILYLNFSSNFLTGPLPLEIGKLKVLVGIDFSMNNFSGVIPTKIGGLKNLEYLFLGYNRLQGSIPDSFGDLTSLKSLNLSNNNLSGTIPASLEKLSYLENLNLSFNKLEGEIPRGGSFGKFSAESFKGNELLCGSPNLQVPPCKTSIHHTSWKNSLLLGIVLPLSTTFMIVVILLILRYRQRGKQPSNDANMPLVAMWRMFPYLELCRATDGFSENNLIGKGGFGSVYKARLGDGMEVAVKVFNLECGRAFKSFDVECDMMKSIRHRNLIKVISSCSNEEFKALVLEYMPHGSLEKYLYSSNCILDIFQRLNIMIDVASALEYLHFGYSAPVIHCDLKPSNVLLDDNMVAHLSDFSIAKLLTGEDQSMTQTQTLATIGYMAPEYGREGRVSANGDVYSFGIMLMETFTGKKPTDEIFNEEMTLKHWVNDWLPISTMEVVDVNLLSQEDIHFVAKEQCVSFVFNLAMACTVESPEQRINAKEIVTKLLKIRDSYGCFLNLESE

SEQ ID NO: 351 - protein, 1021 aa, Citrus unshiu
MMSRFLLLHCLILISLFIAAATANTSSTITDRDALLALKAHITHDPTNFLAKNWNTSTPVCNWTGVACDVHSHRVTVLNISSLNLIGTIPSQLGNLSSLQSLNLSCNRLSGSIPYTIFTTYTLKHVSLGENQLSGQIPTNICSNLPFLEILFLSENMFHGEIPSALSNCTYLRILSLAYNDFSGAVPREIGNLTKLRELYLGRNRLQGGIPQELGNLAKLEGLQLLQNNLTGEIPLEISNLKNLEELQLGQNKLIGTVPVAIFNVSTLKFLGLQNNSLSGSLSSIANVRLPNLEKLYLWGNNFSGTIPRFIFNASKLSKLSLGMNSFSGFIPSTFGNLRNLEQLGLDENYLTSSTPELSFLSSLSNCKSLTLIALSNNPLDGILPKTSISNLSRSLEEFYMYNCNISGSIPEEISNLTNLVEIDLGGNKLNGSIPITLGKLRKLQRLNLEDNILEGSIPDDICRLAELYRLELGSNKLYGSIPACFGNLASLRILSLGSNKLTSIPLTFWNLKDILQLNFSSNFLTGPLLLEIGNLKVLIGIDFSMNNFSGVIPREIGGLKNLEYLFLGYNRLRGSIPDSFGDLISLKFLNLSNNNLSGAIPTSLEKLSYLEDLNLSFNKLEGEIPRGGSFGNFSAESFEGNELLCGSPNLQVPPCKTSIHHTSWKNSLLLGIVLPLSTTLLIVVIWLILRYRQRGKKPSNDANMPLVATWRTFSYLELCRATDEFSENNLIGRGGFGSVYKARLGDGMEVAVKVFNLQCGRAFKSFDVECEMMKSIRHRNLIKVISSCSNEEFKALVLEYMPNGSLEKYLYSSNCILDIFQRLNIMIDVASALEYLHFGYSALVIHCDLKPSNVLLDDNMVAHLSDFSIAKLLTGEDQSMTQTQTLGTIGYMAPEYGREGRVSTNGDVYSFGIMLMETFAGKKPTDEIFNEEMTLKQWVNGWLPISTVEVVDPNLLSQEDVHFVAKEQCVSFVFNLAMACTVESPEKRINAKEIVTKLLKIRGSLLRNVGGRCIRQSNLN

SEQ ID NO: 352 - protein, 1125 aa, Citrus sinensis
MERLHSLSIMSRFRLLHCLILISLFIAAATANTSTITTDRDALLALKAHITHDPTNFFAKNWNTSISFCNWTGVTCDVHSHRVTVLNISRLNLTGTIPSQLGNLSSLQSLNLSFNRLSGSIPSAIFTMYTLKYVSFRENQLSGAFPSFIFNKSSLQHLDFSQNTLSGEIPANICSNLPFLEYISLSKNMFHGGIPSALSKCTYLQILSLSFNDFSGAIPKDIGNLTKLMELYLGRNRLQGEIPREFGSLAELELMSLRESNLQGGIPQELGNLAKLEMLQLFQNNLTGAIPKEIGNLTKLEELYLGINRLQGEIPREFSNLAKLEMMSLSENNLQGEIPHEISNLQNLEELDLGHNKLVGTVPAAIFNVSTLKGFSVSNNSLSGCLSSIVDARLPNLEVLYLWGNNFSGTIPRFIFNVSKLSKLSLEKNSFSGFIPNTFGNLRNLKWLILYDNYLTSSTPGLSFLSSLSNCKSLTYIDLSHNPLDSILQRMSIGNLSHSLEEFQMYNCNVSGGIPEEIRNLSNLTLIDLGGNKLNGSIPITLSKLQKLQGLGLENNKLEGSIPDDICRLAELFRLELGGNKLSGSIPTCFSNLASLRILSLGSNELTSIPLTFWNLKDILQLNFSSNFLTGPLPLEIGNLKVLVGIDLSMNNFSGVIPTEIGGLKNLEYLFLGYNRLQGSIPNSFGDLINLKFLNLSNNNLSGAIPASLEKLSYLEDLNLSFNKLEGEIPRGGSFGNFSAESFEGNELLCGSPNLQVPPCKTGIHHTSSKNSLLLGIVLPLSTIFMIVVSLLILRYRQRGKRPSNDANMPLVATWRMVSYLELCRATDGFSENNLIGKGGFGSVYKARLSDGMEVAVKVFNLQCGRAFKSFDIECEMMKSIRHRNLIKVISSCSNEEFKALVLEYMPHGSLEKYLYSSNCILDIFQRLNIMIDVASALEYLHFGHSAPIIHCDLKPSNVLLDDNMVAHLSDFSIAKLLIGEDQSMTHTQTLATIGYMAPEYGREGRVSTNGDVYSFGIMLMETFTEKKPTDEIFNEEMTLKQWVNDWLPISTMEVVDGNLLSQEDIHFVAKEQCVSYVFNLAMACTVESPKQRINAKEIVTKLLKIRGSLLRNVGGRCIRQSNLN

SEQ ID NO: 353 - protein, 1077 aa, Citrus sinensis
MERLHSLRMMSRFLLLHCLILISLFIAAATANTSSTITDRDALLALKAHITHDPTNFLAKNWNTSTPVCNWTGVACDVHSHRVTVLNISSLNLTGTIPSQLGNLSSLQSLNLSCNRLFGSIPSAIFTIYTLKYVSLRENQVSGQIPANICSNLPFLDYLSLGKNMFHGGIPSALSNCTYLQILHLSYNDFSGAVPKDIGNLSKLKELYLGRNRLQGEIPREFVNLTELERMSLSENELQGGIPRELGNLTKLERLQLFWNNLTGAIPKEIGNLTKLKELSLDGNRLQGEIPLEISNLQNLEELDLRHNKLVGTVPAAIFNMSMLKLLHLQNNSLLGCLSSIADVRLPNLEALLLWGNNFSGTIPRFIFNASKLSILELSQNSFSGFIPNTFGNLRNLEWLNLRDNYLTSSTPELSFLSSLSNCKSLTFIHLSDNPLDGILSKTSIGNLSHSLKDFYMSNCNVSGGIPEEITNLTNSITIDLGGNKLNGSIPITLSKLQKLQGLGLDDNKLEGSIPDSICRLTELYELELGGNKLFGSIPACFSNLASLRILSLSSNELTSIPLTFWNLKDILQLNFSSNFLTGPLPLEIGNLKVLIGIDFSMNNFSSVIPTEIGGLKNLEYLFLGYNRLEGSIPDSFGDLISLKFLNLSNNNLSGAIPTSLEKLSYLEDLNLSFNKLEGEIPRGGSFGNFAAESFEGNELLCGSPTLQVLPCKTSIHHTSWKNSLLLGIVLPLSTTLLIVVIWLILRYRKRGKQPSNDANMPLVATWRTFSYLELCRATNGFSENNLIGRGGFGSVYKARLGDGMEVAVKVFNLQCGRAFKSFAVECEMMKSIRHRNLIKVISSCSNEEFKALVLEYKPHGSLEKYLYSSNCILDIFQRLNIMIDVASALEYLHFGCSAPVIHCDLKPDNVLLDDNLVAYLSDFGIAKLLIGEDQSMTQTQTLATIGYMAPEYGREGRVSTNGDVYSFGIMLMETFTGKKPTDEIFNGEMTLKHWVNDWLPISTMEVVDANLLSQEDVHFVAKEQCVSFVFNLAMACTVESHEQRINAKEIVTKLLKIRDSLLRNVGGRRISQPNLN

SEQ ID NO: 354 - protein, 1101 aa, Citrus sinensis
MERLHSLRMMSRFLLLHCLILISLFIAAATANTSSTITDRDALLALKAHITHDPTNFLAKNWNTSTPVCNWTGVACDVHSHRVTVLNISSLNLTGTIPSQLGNLSSLQSLNLSCNRLFGSIPSAIFTIYTLKYVSLRENQVSGQIPANICSNLPFLDYLSLGKNMFHGGIPSALSNCTYLQILHLSYNDFSGAVPKDIGNLSKLKELYLGRNRLQGEIPREFVNLTELERMSLSENELQGGIPRELGNLTKLEGLQLFRNNLTGGIPRELGNLTKLERLQLFWNNLTGAIPKEIGNLTKLKELSLDGNRLQGEIPLEISNLQNLEELDLRHNKLVGTVPAAIFNMSMLKLLHLQNNSLLGCLSSIADVRLPNLEALLLWGNNFSGTIPRFIFNASKLSILELSQNSFSGFIPNTFGNLRNLEWLNLRDNYLTSSTPELSFLSSLSNCKSLTFIHLSDNPLDGILSKTSIGNLSHSLKDFYMSNCNVSGGIPEEITNLTNSITIDLGGNKLNGSIPITLSKLQKLQGLGLDDNKLEGSIPDSICRLTELYELELGGNKLFGSIPACFSNLASLRILSLSSNELTSIPLTFWNLKDILQLNFSSNFLTGPLPLEIGNLKVLIGIDFSMNNFSSVIPTEIGGLKNLEYLFLGYNRLEGSIPDSFGDLISLKFLNLSNNNLSGAIPTSLEKLSYLEDLNLSFNKLEGEIPRGGSFGNFAAESFEGNELLCGSPTLQVLPCKTSIHHTSWKNSLLLGIVLPLSTTLLIVVIWLILRYRKRGKQPSNDANMPLVATWRTFSYLELCRATNGFSENNLIGRGGFGSVYKARLGDGMEVAVKVFNLQCGRAFKSFAVECEMMKSIRHRNLIKVISSCSNEEFKALVLEYKPHGSLEKYLYSSNCILDIFQRLNIMIDVASALEYLHFGCSAPVIHCDLKPDNVLLDDNLVAYLSDFGIAKLLIGEDQSMTQTQTLATIGYMAPEYGREGRVSTNGDVYSFGIMLMETFTGKKPTDEIFNGEMTLKHWVNDWLPISTMEVVDANLLSQEDVHFVAKEQCVSFVFNLAMACTVESHEQRINAKEIVTKLLKIRDSLLRNVGGRRISQPNLN

SEQ ID NO: 355 - protein, 1077 aa, Citrus sinensis
MERVHSFRMMSRFLLLHCLILISLFIAAATANTSSTITDRDALLALKARITHDPTNFLAQNWNTSTPVCNWTGVACDVHSHRVTVLNISSLNLTGTIPSQLGNLSSLQSLNLSFNRLSSSIPSAIFTIYTLQNVSLRKNQLTGTFPSFIFNKSSLQHLDFSFNTLSGEIPANICSNFPFLEYLALSNNMFHGGILSALSNCTYLQKLDLVYNDFSGAVPREIGNLTKLKELHLGRNRFQGEIPREFGNLAELEQMSLAENNLQGGIPQELGNLAKLKTLQLFQNNLTGEIPPEIGNLRNLEELDLGHNKLVGTVPAAIFNLSTLKEFSIPNNSLSGCLSSIADVRLPNLEVLNFWGNNFSGTIPRFIFNASKLSALDLDGNSFSGFIPNTFGNLRNLKWLILSDNYLTSSTPELSFLSSLSNCKSLTYIDLSYNPLDSILPRTSVGNLSHSLEDFEMNNCNVSGGIPEEISNLTNLTTIDLGGNKLNGLIPITLSKLQKLQGLVLYDNKLEGSIPDDICRLAELYELELDGNKLSGSIPACLSNLISLRILSLGSNELTSIPLIFWNLEDILYLNFSSNFLTGPLPLEIGKLKVLVGIDFSMNNFSGVIPTKIGGLKNLEYLFLGYNRLQGSIPDSFGDLTSLKSLNLSNNNLSGTIPASLEKLSYLENLNLSFNKLEGEIPRGGSFGKFSAESFKGNELLCGSPNLQVPPCKTSIHHTSWKNSLLLGIVLPLSTTFMIVVILLILRYRQRGKQPSNDANMPLVATWRMFPYLELCRATDGFSENNLIGKGGFGSVYKARLGDGMEVAVKVFNLECGRAFKSFDVECDMMKSIRHRNLIKVISSCSNEEFKALVLEYMPHGSLEKYLYSSNCILDIFQRLNIMIDVASALEYLHFGYSAPVIHCDLKPSNVLLDDNMVAHLSDFSIAKLLTGEDQSMTQTQTLATIGYMAPEYGREGRVSANGDVYSFGIMLMETFTGKKPTDEIFNEEMTLKHWVNDWLPISTMEVVDVNLLSQEDIHFVAKEQCVSFVFNLAMACTVESPEQRINAKEIVTKLLKIRDSLLRNVGGRCIRQSNLN

SEQ ID NO: 356 - protein, 1094 aa, Citrus sinensis
MMSRFLLLHCLILISFFIAAATANTSSTITDRDALLALKARITHDPTNFLAKNWNTSTHVCNWTGVACDVHSHRVTVLNISSLNLTGIIPSQLGNLSSLQSLNLSCNRLSGSIPSAIFTIYTLKYVSFRENQLSGAFSSFIFNKSSLQHLDFSHNTLSGEIPANICSSLPFLDFLSLQENMLHGGIPSTLSNCTYLQKLGLVYNNFSGAIPKEIGNLTKLKILYLGGNRLQGEIPREFGNLADLERMSLSENNLQGGIPRELGNLTKLEILQLFRNNLTGAIPRELGNLTGLGVLELSENFLTGEIPLEIGNLQNLEELELGHNKLIGTVPVAIFNVSTTLKLLGLQDNSLSGGLSSIANVRLPNLEELYLWGNNFSGTIPRFIFNASKLSILDLDKNSFSGFIPNTFGNLRNLEYLDLQYNYLTSLTLELSFLSSLSNCKSLTLIGLSNNPLDGILPRTSVGNLSHSLKYFKMHNCNISGGIPEEISNLTNLMTIDLGGNKLNGSIPITLGKLQKLQWLSLDDNKLEGSIPDDICRLAELYLLELGGNKLYGLIPACFGNLASLRILSLCSNELTSIPLTFWNLKDILHLYFSLNFFTGPLPLEIGNLKVLIGIDFSMNNFSGVIPTEIGGLKNLESLFLGYNRLRGSIPDSFGDLISLKFLNLSNNNLSGAIPTSLEKLSYLEDLNLSFNKLEGEIPRGGSFGNFLAESFEGNELLCGSPNLQVPPCKTSIHHTSWKKSLLLGTILPLSTTFMIVVIWLILRYRQRGKRPSNDANMPLVATWRMFSYLELCRATSGFSENNLIGRGGFGSVYKARLGDGMEVAVKVFNLQCERAFKSFDVECEVMKSIRHRNLIKVISSCSNEEFKALVLEYMPHGSLEKYLYSSNCILDIFQRLNIMIDVASALEYLHFGCSTPVIHCDLKPNNVLLDDNMVAYLSDFGIAKLLIGEDQSMTQTQTLATIGYMAPEYGREGRVSTNGDVYSFGIMLMETFTGKKPTDEIFNGEMTLKHWVNDWLPISTMEVVDANLLSQEDVHFVAKEQCVSFVFNLAMACTVESHEQRINAKEIVTKLLKIRDSLLRNVGGRRIRQPNLN

SEQ ID NO: 357 - protein, 1077 aa, Citrus sinensis
MERVHSLRMMSIFLLLHCLIIISLFIAATTANTSSNITDRDALLALKAHITHDPTNFLAKNWNTSTPVCNWTGVACDIHSHRVTVLNISSLNLRGTIPSQLGNLSSLQSLNLSCNRLSGSIPSAIFTIYTLKNVSLGKNQLSGQIPTNICSNLPFLEFLSLSLNMFHGGIPSTLSNCTYLRILSLAYNDFSGAVPREIGNLTKLKVLYIGANRLQGEIPREFGNLTELEQFSLPTNNLQGGIPQELGNLAKLEILQLFQNNLTGPIPRELGNITGLGILALSDNFLTGEIPTEISNLRNLEELDLARNKLVGIVPAAIFNVSTLQHLGLQDNSLLGCLSSNGDVRLPNLEGLYLSGNNFSGTIPRFIFNASKLFKLSLQRNSLFGFIPNTFGNLRNLKWLSLYDNYLTSSTPELSFLSSLSNSKSLTFIDLSNNPLDSVLPKTFVGNVSHSLEFFVMSYCNISGVIPEEITNLTKLTTIILGGNKLNGSIPITLSKLQKLQYLGLDDNKLEGSIPDSICRLAELYDLELGGNKLSGSIPACFSNLASLRTLSLDSNELTYIPLTFWNLKDILYLNFSSNFLIGPLPLEVGNLKVLVGIDFSMNNFSGVIPTEIGGLQNLEYLFLGYNRLQGSIPDSFGDLISLKSLNLSNNNLSGAIPASLEKLLYLEDLNLSFNKLEGEIPRGGSFGNFSAESFEGNELLCGSPNLQVPPCKTSIHPTSSKNSLLLGIVLPLSTTFMIVVILLILRYRQRGKRPSNDANIPLVATWRMFSYLELCQATDEFSENNLIGKGGFGSVYKARLGDGMEVAVKVFNLQCGRAFKSFDIECEMMKSIRHRNLIKVISSCSNEEFKALVLEYMPHGSLEKYLYSSNCILDIFQRLNIMIDVASTLEYLYFGHSAPIIHCDLKPSNVLLDDNMVAHLSDFSIAKLLTGDDQSMTQTQTFATIGYMAPEYGREGRVSANGDVYSFGIMLMETFTGKKPTDEIFNEEMTLKQWVNDWLPISTMEVVDANLLSPEDVHFVAKEQCVSFVFNLAMACTVESPEQRINAKEIVTKLLKIRGSLLRNVGGRCIRQSNLN

SEQ ID NO: 358 - protein, 646 aa, Citrus sinensis
EIPLEISNLQNLEELDLRHNKLVGTVPAAIFNMSMLKLLHLQNNSLLGCLSSIADVRLPNLEALLLWGNNFSGTIPRFIFNASKLSILELSQNSFSGFIPNTFGNLRNLEWLNLRDNYLTSSTPELSFLSSLSNCKSLTFIHLSDNPLDGILSKTSIGNLSHSLKDFYMSNCNVSGGIPEEITNLTNSITIDLGGNKLNGSIPITLSKLQKLQGLGLDDNKLEGSIPDSICRLTELYELELGGNKLFGSIPACFSNLASLRILSLSSNELTSIPLTFWNLKDILQLNFSSNFLTGPLPLEIGNLKVLIGIDFSMNNFSSVIPTEIGGLKNLEYLFLGYNRLEGSIPDSFGDLISLKFLNLSNNNLSGAIPTSLEKLSYLEDLNLSFNKLEGEIPRGGSFGNFAAESFEGNELLCGSPTLQVLPCKTSIHHTSWKNSLLLGIVLPLSTTLLIVVIWLILRYRKRGKQPSNDANMPLVATWRTFSYLELCRATNGFSENNLIGRGGFGSVYKARLGDGMEVAVKVFNLQCGRAFKSFAVECEMMKSIRHRNLIKVISSCSNEEFKALVLEYKPHGSLEKYLYSSNCILDIFQRLNIMIDVASALEYLHFGCLAPVIHCDLKPDNVLLDDNLVAYLSDFGIAKLLIGED

SEQ ID NO: 359 - protein, 820 aa, Citrus clementina
MCSNLYGTNKALTVCSLSILHEWLFLCVSTGEIPTEISNLRNLEELDLARNKLVGIVPAAIFNVSTLQHLGLQDNSLFGCLSSIGDVRLPNLEGLYLSGNNFSGTIPRFIFNASKLFKLSLQRNSFFGFIPNTFGNLRNLKWLSLYDNYLTSSTPELSFLSSLSNSKSLTFIDLSNNPLDSVLPKTFVGNVSHSLEFFVMSYCNISGSIPEEITNLTKLTTIILGGNKLNGSIPITLSKLQKLQYLGLDDNKLEGSIPDSVCRLAELYDLELGGNKLFGSIPACFSNLASLRTLSLDSNELTSIPLTFWNLKDILYLNFSSNFLIGPLPLEVGNLKVLVGIDFSMNNFSGVIPTEIGGLQNLEYLFLGYNRLQGSIPDSFGDLISLKSLNLSNNNLSGAIPASLEKLLYLEDLNLSFNKLEGEIPRGGSFGNFSAESFEGNELLCGSPNLQVPPCKTGIHHTSSKNSLLLGIVLPLSTIFMIVVILLILRYRQRGKRPSNDANMPLVATWRMFSYLELCRATDGFSENNLIGKGGFGSVYKARLGDGMEIAVKVFNLQCGRAFKSFDIECEMMKSIRHRNLIKVISSCSNEEFKALVLEYMPHGSLEKYLYSSNCILDIFQRLNIMIDVASALEYLHFGHSAPIIHCDLKPSNVLLDDNMVGHLSDFSIAKLLTGEDQSMTHTQTLATIGYMAPEYGREGRVSANGDVYSFGIMLMETFTRKKPTDEMFNGEMTLKHWVNDWLPISTMEVVDANLLSQEDIHFVAKEQCVSFVFNLAMECTVESPKQRINAKEIVAKLLKIRDSLLRNVGGRCIRQSNLN

SEQ ID NO: 360 - protein, 811 aa, Citrus clementina
MCSNLYGTNKALTVCSLSILHEWLFLCVSTGNNCVIPTEISNLRNLEELDLARNKLVGIVPAAIFNVSTLQHLGLQDNSLFGCLSSIGDVRLPNLEGLYLSGNNFSGTIPRFIFNASKLFKLSLQRNSFFGFIPNTFGNLRNLKWLSLYDNYLTSSTPELSFLSSLSNSKSLTFIDLSNNPLDSVLPKTFVGNVSHSLEFFVMSYCNISGSIPEEITNLTKLTTIILGGNKLNGSIPITLSKLQKLQYLGLDDNKLEGSIPDSVCRLAELYDLELGGNKLFGSIPACFSNLASLRTLSLDSNELTSIPLTFWNLKDILYLNFSSNFLIGPLPLEVGNLKVLVGIDFSMNNFSGVIPTEIGGLQNLEYLFLGYNRLQGSIPDSFGDLISLKSLNLSNNNLSGAIPASLEKLLYLEDLNLSFNKLEGEIPRGGSFGNFSAESFEGNELLCGSPNLQVPPCKTGIHHTSSKNSLLLGIVLPLSTIFMIVVILLILRYRQRGKRPSNDANMPLVATWRMFSYLELCRATDGFSENNLIGKGGFGSVYKARLGDGMEIAVKVFNLQCGRAFKSFDIECEMMKSIRHRNLIKVISSCSNEEFKALVLEYMPHGSLEKYLYSSNCILDIFQRLNIMIDVASALEYLHFGHSAPIIHCDLKPSNVLLDDNMVGHLSDFSIAKLLTGEDQSMTHTQTLATIGYMAPEYGREGRVSANGDVYSFGIMLMETFTRKKPTDEMFNGEMTLKHWVNDWLPISTMEVVDANLLSQEDIHFVAKEQCVSFVFNLAMECTVESPKQRINAKEIVAKLLKIRDSLLRN

SEQ ID NO: 361 - protein, 1094 aa, Citrus sinensis
MMSRFLLLHCLILISLFIAAATANTSSTITDRDALLALKAHITHDPTNFLAKNWNTSTPVCNWTGVTCDVHSHRVTVLNISSLNLTGTIPSQLGNLSSLKSLNLSFNRLSGSIPSTIFTTFTLTYVSLRQNQLSGQIAANICSNLPFLEVLSLSRNMFQGGIPSTLSNCTYLQTLALSYNNFSGTIPIEIGNLTKLKELYLGVNRLQGEIPREFGNLADLEQMSLAINNLQGGIPRELGNLTKLEMLQLFENNLTGAIPKEIGNLTKLKELSLFGNRLQGAIPRELGNITRLGILALPNNFLTGEIPLEIGNLQNLEELDLGLNKLIGTVPATIFNVSTLKLLLLEHNSLLGSLSSIANVRLPNLEELLLWGNNFSGTIPRFIFNASKLSILELSKNSFSGFIPNTFGNLRNLNWLYLNDNNLASSTPELSFLSSLSNCKSLTHIALSHNPLDGILPRTSVGNLSHSLKEFYMSNCNVSGGIPEEITNLTNLTTIYLGGNKLNGSIPITLSKLQKLQGLGLEDNKLEGSIPDSICHLTELYDLKLGGNKLFGSIPACFNNLDSLRILSLGSNELTSIPLTFWNLKDILYLNFSSNFFTDPLPLEIGNLKVLIGIDFSMNNFSGVIPTEIGGLKDLEYLFLGYNRLQGSIPDSFGNLISLKFLNLSNNNLSGAIPASLEKLSYLEDLNLSFNKLEGEIPRGGSFGNFSAESFEGNELLCDSPNLQVPPCKTSIHHTSWKISLLLGIVLPLSTTFMIVVILLILRYRQRGKQPSNDANMPLVATWRTFSYLELCRATDGFSENNLIGKGGFGSVYKARLGDGMEVAVKVFNLQCRRAFKSFDVECEMMKSIRHRNLIKVISSCSNEEFKGLVLEYMPQGSLEKHLYSSNCILDIFQRLNIMINIASALEYLHFGCSTPVIHCDLKPSNVLLDDNMVAHLSDFSIAKLLIGEDQSMTHRYKYFLFLANFLIKYGREGRVSTNGDVYSFGIMLMETFTEKKPTDEIFNEEMTLKQWVNDWLPISTMEVVDANLLSQEDVHFVAKEQCVSFVFNLAMACTVESHEQRINAKEIVTKLLKIRGSLLRNVGGRCLRQSNLN

SEQ ID NO: 362 - protein, 1555 aa, Citrus sinensis
MYTAVLVHKEPDSVGEALQDTNWFTAMKNEYDALIENRTWSLVRRTENQKVVGNKWVYRIKYNTDGSVAKYKARLVAKGFQQIEGVNYFDTFSPVIKPATVRVVLSLAVMNQWIVRQVDVNNAFLNGELSEEVFIQQPEGFVDKSNLTMFADYTKLYMVLSKLLEPVTGLNSEELDSFIQQFNTVFALKDLGRLSYFLGIEVLYDQDCIYLSQKKYIRDLLAKVDMLECKRVTTPMCSGKDSKLQKVVKGELGYYVEDATHYRSIVGGLQYLILTRPEIAYSVHKLSQYVSAPTMQHLMACKRVLKYLKETQDYGLKFVKDGDLKITAFTDVDWGSDLDDRKSIGAYCVYLGNNLISWSSKKQTVVTKSSAESEYRAFASAASEIAWLKSLFLEMEVYCVERPTIWCDNISATELAKNPVFHSRTKHIEIDVHFIRDKVLSGDLKICYVPSEDQIADILTKPLSSPQFNYLRDKLNVFSCPLSLRGAVKIAHCAEVRKKSQRVKLPAVICATCQTAAFIQFYNFLHTGTIPSQLGNLSSLQSLNLSFNRLSGSIPSTTFTTYTLKFVGLQGNQLSGALPFFIFNKSSLQDLDLSDNALSGEIPANICSSLPFLEYISLSQNMFHGGIPSALSKCTYLQILGLSFNDFSGAIPKEIGNLTKLQELYLGRNRLRGEIPRELSNLAELEQMWLSENELQGGIPQDLGNLAKLKMLQLSQNNLTVLSFNDFSGAIPKEIGNLTKLQELYLGRNRLRGEIPRELSNLAELELMSLFDNELQGEIPPEISNLSNLEQLELGSNKLVGTVPTAIFNVSTLQALGLQNNSLSGSLSSIVDVRLPNLKMLQMWENNFSGTIPRFIFNASKLSILELSDNSFSGFIPNTFGNLRNLQALRLSNNYLTSSTLEFSFLSSLSNCKSLTLISFSNNPLDGILPKTSVGNLSHSLEYFEMAYCNVSGGIPEEIGNLTNLTGIYLGGNKLNGSIPSTLGKLQKLQGLGLENNKLEGSIPDSICHSDELYKLELGGNKLSGSIPECFNNLASLRILLLGSNELTSIPLTFWNLKDILYLNFSSNFFTGPLPLEIGNLKVLVGIDFSMNNFSGVIPMAIGGLKNLQNLFLGYNRLQGSIPDSFGDLISLISLNLSNNNLSGAIPASLEKLSYLENLNLSFNKLEGEIPRGGSFGNFSFESFEGNELLCGSPNLRVPPCKTSIHHISRKNAFLLGIVLPLSTVFMIVVIFLIVKCRKRERGPPNDANMPPEAMQRMFSYLELCRATDGFSENNLIGRGSFGSVFKARLGDGMEVAMKVFNLQYGRVFKSFDVECEMMKSIRHRNIIKVISSCSNEEFKALVLEYMPHGSLEKYLHSSNYILDIYQRLNIMIDVASALEYLHFGYSAQVIHCDLKPSNVLLDDNMVAHLSDFGIAKLLTREDQSTIQTQTLATIGYMAPEYGKEGRVSANGDVYSFGIMLMETFTRKKPTDEIFNGEMTLKHWVNDWLPISTKEIVDPNLLSREDINFVAKEQCVSFVFNVAMECTVESPEQRINAKEIVTKLLKIRDSLLRNV

SEQ ID NO: 363 - protein, 988 aa, Citrus sinensis
MERLHSLRMMSRFLLLHCLILISLFIAAATANTSSTITDRDALLALKAHITHDPTNFLAKNWNTSTPVCNWTGVACDVHSHRVTVLNISSLNLTGTIPSQLGNLSSLQSLNLSCNRLFGSIPSAIFTIYTLKYVSLRENQVSGQIPANICSNLPFLDYLSLGKNMFHGGIPSALSNCTYLQILHLSYNDFSGAVPKDIGNLSKLKELYLGRNRLQGEIPREFVNLTELERMSLSENELQGGIPRELGNLTKLEGLQLFRNNLTGGIPRELGNLTKLERLQLFWNNLTGAIPKEIGNLTKLKELSLDGNRLQGEIPLEISNLQNLEELDLRHNKLVGTVPAAIFNMSMLKLLHLQNNSLLGCLSSIADVRLPNLEALLLWDNPLDGILSKTSIGGNKLNGSIPITLSKLQKLQGLGLDDNKLEGSIPDSICRLTELYELELGGNKLFGSIPACFSNLASLRILSLSSNELTSIPLTFWNLKDILQLNFSSNFLTGPLPLEIGNLKVLIGIDFSMNNFSSVIPTEIGGLKNLEYLFLGYNRLEGSIPDSFGDLISLKFLNLSNNNLSGAIPTSLEKLSYLEDLNLSFNKLEGEIPRGGSFGNFAAESFEGNELLCGSPTLQVLPCKTSIHHTSWKNSLLLGIVLPLSTTLLIVVIWLILRYRKRGKQPSNDANMPLVATWRTFSYLELCRATNGFSENNLIGRGGFGSVYKARLGDGMEVAVKVFNLQCGRAFKSFAVECEMMKSIRHRNLIKVISSCSNEEFKALVLEYKPHGSLEKYLYSSNCILDIFQRLNIMIDVASALEYLHFGCSAPVIHCDLKPDNVLLDDNLVAYLSDFGIAKLLIGEDQSMTQTQTLATIGYMAPEYGREGRVSTNGDVYSFGIMLMETFTGKKPTDEIFNGEMTLKHWVNDWLPISTMEVVDANLLSQEDVHFVAKEQCVSFVFNLAMACTVESHEQRINAKEIVTKLLKIRDSLLRNVGGRRISQPNLN

SEQ ID NO: 364 - protein, 1092 aa, Citrus unshiu
MMSRFLLLHCLILISLFIAASTANSSSTITDRDALLALKARITHDPTNFLAKNWNTSTPVCNWTGVACDVHSHRVTVLNISSLNLTGPIPSQLGNLSSLQSLNLSCNRLSGSIPSAIFTTYTLKYVSFRKNQLSGQIPANICSNLPVLEYLSLSQNMFQGGIPSTLSNCTYLRILSLAYNDFSGAVPKDIGNLTKLKELYLGVNRLQGEIPREFGNLAEMELMSLSENKLRGGIPRELGNLTKLEMLQLFQNNLTGKIPREFGNLADLEWMSLWENNLQGAIPRELGNLTGLGILELSHNFLTGKIPPEIGNLRNLEELVLGANQLVGIVPAAIFNVSTLKLLKLQNNFLLGCLSPIEDVRLPNLEELSLWGNNFSGTIPRFIFNASKLSTLELGDNSFSGFIPNIFGNLRNLKWLNLPNNYLASSSPELSFLSSLSNCKSLTHLSLSNNPLDGILPRTSVGNLSHSLKKFDMSNCNVSGGIPEEITSLTNLTTIYLGGNKLNGSIPITLSKLQKLQGLGLEDNKLEGSIPDDICRLVELYKVELGGNKLSGSIPACFGNLIALRILSLGSNELTSIPLTFWNLKDILQLNFSSNFLTGPLPLEIGNLKVLIGIDFSMNNFSGVIPTEIGGLKYLEYLFLGYNRLQGLIPDSFGNLISLKFLNLSNNNLSGAIPASLEKLLYLEDLNLSFNKLEGEIPRGGSFGNFSAESFEGNELLCGSPLQVPPCKTSIHHTSWKISLLLGIVLPLSTTLIIVVIWLILRYRLRGKQPSNDANMPLVATSRTFSYLELCRATDGFNENNLIGRGGFGSVYKARLGDGMEVAVKVFNLQCRRAFKSFDVECEIMKSIRHRNLIKVISSCSNEEFKGLVLEYMPQGSLEKHLYSSNCILDIFQRLNIMIDVASALEYLHFGCSTPIIHCDLKPSNVMLDDNMVAYLSDFGIAKLLIGEDQSMTQTQTLATIGYMAPEYGREGRVSTNGDVYSFGIILMETFTGKKPTDEIFNGEMTLKHWVNDWLPISTMEVVDANLLSQEDIHFAAKEQCVSFVFNLAMVCTVESLEQRINAKEIVKKLLKIRDSLLRNVGGRCIRQSNLN

SEQ ID NO: 365 - protein, 1019 aa, Citrus unshiu
TANTSSTITDRDALLALKAHITHDPTNFLAKNWNTSTPVCNWTGVACDVHSHRVTVLNISSLNLTGTIPSQLGNLSSLQSLNLSCNRLSGSIPSAIFTIYTLKYVSFRENQLSGAFSSFIFNKSSLQHLDFSHNTLSGEIPANICSSLPFLDFLSLQENMFHGGIPSTLSNCTYLQKLGLVYNNFSGAIPKEIGNLTKLKILYLGGGIPQELGNLAKLEMLQLFQNNLIGEIPLEIGNLQNLEELELAQNKLIGIVPVAIFNVSTLKILQLQINCLSGSLSSITDVQLPNLEKLDLWGNNFSGTIPRFIFNASKLSILNLGGNSFSGFIPNTFGNLRNLKYLYLENNYLTSSTLELSFLSSLSNCKSLTHIDLSNNPLDGILPKTSVGNLSHSLEDFHMYNCNISGGIPEEISNLTNLITIDLGGNKLNGSILITLSKLQKLQGLVLDDNKLEGSIPDDICRLVELYKLELGGNKLSRSIPACFNNLIALRILSLGSNELTSIPLTFWNLKDILYLNFSSNFLTGPLPLKIGNLKVLVGIDFSMNNFSGVIPTEIGGLKDLEYLFLGYNRLQGSIPDSFGNLISLKFLNLSNNNLSGAIPAPLEKLSYLEDLNLSFNKLEGEIPRGGSFGNFSVESFKGNELLCGSPNLQVPPCKTSIHHTSWKISLLLGILLPLSTTLMIVVIWLILRYRQRGKQPSNDANMPLVAMWRTFSYLELCRATDGFSENNLIGRGGLGSVYKARLGDGMEVAVKVFNLQCRRAFKSFDVECEIMKSIRHRNLIKVISSCSNEEFKGLVLEYKPQGSLEKHLYSSNCILDIFQRLNIMIDVASALEYLHFGCSAPVIHCDLKPDNVLLDDNLVAYLSDFGIAKLLIGEDQSMTQTQTLATIGYMAPEYGREGRISTNGDVYSFGIMLMETFTGKKPTDEIFNEEMTLKQWVNDWLPISTMEVVDANLLSQEDVHFVAKEQCVSFVFNLAMACTVESPEQRINAKEIVTKLLKIRGSLLRNFGGRCIRQSNLN

SEQ ID NO: 366 - protein, 899 aa, Citrus clementina
MKIRALPKEIGNLTKLKELSLNHNRLQGEIPREFGNLAELELMWLSENNLQGGIPRELGNLTKLEILHLWKNNLTGALPKEIGNLTKLKHLSLDHNRLQGEIPREFGNLAELELLSLYENKLQGEIPLEIGNLRNLKDLILSENKLVGIVPFAIFNVSTLKLLQLQNNSLLGCLSSIANVRLPNLEELDLWANNFSGTIPHFIFNTSKLSRLDLNSNSFSGFIPNTFDNLRNLEWLSLRDNYLTSSTPKLSFLSSLSNCNSLRFIDLSDNPLDGILPKTSIGNLSHSLKEFYMSNCNVSGGIPEEISNLTHLTTIILGGNKLNGSIPITLGKLQKLQGLGLGDNKLEGSIPDDICRLAELYRLELGGNKLYGSIPTCFGNLASLRILSLGSNKLTSIPLTFWNLKDILQLNFSSNFLTGPLPLEIGNLKVLIVIDFSMNNFSGVISTEIGGLKNLEYLFLGYNRLRGSIPDSFGDLISLKSLNLSNNNLSGAIPTSLEKLSYLEDLNLSFNKLEGEIPRGGSFANFSAESFEGNELLCGSPNLQVPPCKTSIHHTSWKNSLLLGIVLPLSTTLLIVVIWLILRYRQRGKQPSNDANMSLVATWRKFSYLELCRATDGFSENNLIGRGGFGSVYKARLGNGMEVAVKVFNLQCGRAFKSFDVECEMMKSIRHRNLIKVISSCSNEEFKALVLEYMPHGSLEKYLYSSNCILDIFQRLNIMIDVASALEYLHFGCSALVIHCDLKPSNVLLGDNMVAHLSDFGIAKLLIGEDQSMTQTQTLGTIGYMAPEYGREGRVSANGDVYSFGIMLMETFTGKKPTDEIFNGEMTLKHWVNELLPISTMEVVDANLLRQEDIHFAAKEQCVSFIFNLAMACTVESPEQRINAKEIFVFGGKVDYVLP

SEQ ID NO: 367 - protein, 993 aa, Citrus sinensis
MERLHSLRMMSRFLLLHCLILISLFIAAATANTSSTITDRDALLALKAHITHDPTNFLAKNWNTSTPVCNWTGVACDVHSHRVTVLNISSLNLTGTIPSQLGNLSSLQSLNLSCNRLFGSIPSAIFTIYTLKYVSLRENQVSGQIPANICSNLPFLDYLSLGKNMFHGGIPSALSNCTYLQILHLSYNDFSGAVPKDIGNLSKLKELYLGRNRLQGEIPREFVNLTELERMSLSENELQGGIPRELGNLTKLEGLQLFRNNLTGGIPRELGNLTKLERLQLFWNNLTGAIPKEIGNLTKLKELSLDGNRLQGEIPLEISNLQNLEELDLRHNKLVDVRLPNLEALLLWDNPLDGILSKTSIGNLSHSLKDFYMSNCNVSGGIPEEITNLTNSITIDLGGNKLNGSIPITLSKLQKLQGLGLDDNKLEGSIPDSICRLTELYELELGGNKLFGSIPACFSNLASLRILSLSSNELTSIPLTFWNLKDILQLNFSSNFLTGPLPLEIGNLKVLIGIDFSMNNFSSVIPTEIGGLKNLEYLFLGYNRLEGSIPDSFGDLISLKFLNLSNNNLSGAIPTSLEKLSYLEDLNLSFNKLEGEIPRGGSFGNFAAESFEGNELLCGSPTLQVLPCKTSIHHTSWKNSLLLGIVLPLSTTLLIVVIWLILRYRKRGKQPSNDANMPLVATWRTFSYLELCRATNGFSENNLIGRGGFGSVYKARLGDGMEVAVKVFNLQCGRAFKSFAVECEMMKSIRHRNLIKVISSCSNEEFKALVLEYKPHGSLEKYLYSSNCILDIFQRLNIMIDVASALEYLHFGCSAPVIHCDLKPDNVLLDDNLVAYLSDFGIAKLLIGEDQSMTQTQTLATIGYMAPEYGREGRVSTNGDVYSFGIMLMETFTGKKPTDEIFNGEMTLKHWVNDWLPISTMEVVDANLLSQEDVHFVAKEQCVSFVFNLAMACTVESHEQRINAKEIVTKLLKIRDSLLRNVGGRRISQPNLN

SEQ ID NO: 368 - protein, 981 aa, Citrus unshiu
MSRFLLLHCLTLISLFIAATTANTITITIDQDALLALKAHITHDPTNFLAKNWNTSTPVCNWTGVTCDVHSHRVTVLNISRLNLTGTIPSQLGNLSSLQSLNLSFNRFFGSIPSAIFTIYTLKYVSFRENQLSGTFPSLILNKSSLQHLDFTHNTLSGEIPANICREIPQEFGNLVKLELMSLPENKLQGEIPSEIGNFHNLEYLDLSLNKLVGVVPSAIFNVSTLKYLGLQNNSLSGSLSSILDFRLPNLEELHLWGNNFSGTIPPFIFNASKLSILELGGNSFSGFIPNAFGNLRNLNYLTLYNNYLTSSTPELSFLSSLSNCKSLRLIDLSNNSLDGILPRTSVGNLSHSLEYFDMSYCNVSGGIPEEINNLTNLITIYLAGNKLNGSIPITLSKLQKLQGLGLQDNKLKGLIPEDICRLAKLYELNLGGNMLSGSIPACFSNLASLRTLSLGFNELTSIPSTFWNLKDILYLNFSSNFFAGPLPLKIGNLKVLIEIDFSMNNFSGVIPTTIGGLKNLQYLSLGNNRLQGSIPNSVGDLISLKSLNLSNNNLSGAIPVSLEKLTYLKDLDLSFNKLEGEIPNGGSFGNFSAESFEGNQLLCGLPNLHVPPCKTSIHHTSWKNALLLGTFLPVSTIFMIVVMLLIVRYRKRGKQALNDANMPPLAKWRMLSYLELCRATDGFSENNLLGRGGFGSVYKARIEDGMDVAVKVFNLEYGRAFKSFDVECEIMKSIRHRNLIKVISSCSNEEFKALVTEYMPHGSLEKYLYSSNYNLDIFQRLNIMIDVALALEYLHFGCSASVIHCDLKPSNVLLDDNMVAHLSDFGIAKLLTGEDQSMIQTQTLATIGYMAPEYGREGRVSANGDVYSFGIMLMETFTGKKPTDKIFNGEMTLTHWVNNWLPISIMKVADANLISQEDVHFAAKEQCMSFVFNLAMECTAESPEQRINAKEIVTRLLKIKDSLLRNVGGLITLCNNSWGV

SEQ ID NO: 369 - protein, 1027 aa, Citrus unshiu
TTANTITITIDQDALLALKAHITHDPTNFLAKNWNTSTPVCNWTGVTCDVHSHRVTVLNISRLNLTGTIPSQLGNLSSLQSLNLSFNRFFGSIPSAIFTIYTLKYVSFRENQLSGTFPSLILNKSSLQHLDFTHNTLSGEIPANICSNLPFLEYFSLFQNMFHGGIPSTLSNCTYLRILSLSSNDFSGPIPKEIGNLTKLKELYLGRNRLHGEIPQEFGNLVKLELMSLPENKLQGEIPSEIGNFHNLEYLDLSLNKLVGVVPSAIFNVSTLKYLGLQNNSLSGSLSSILDFRLPNLEELHLWGNNFSGTIPPFIFNASKLSILELGGNSFSGFIPNAFGNLRNLNYLTLYNNYLTSSTPELSFLSSLSNCKSLRLIDLSNNSLDGILPRTSVGNLSHSLEYFDMSYCNVSGGIPEEINNLTNLITIYLAGNKLNGSIPITLSKLQKLQGLGLQDNKLKGLIPEDICRLAKLYELNLGGNMLSGSIPACFSNLASLRTLSLGFNELTSIPSTFWNLKDILYLNFSSNFFAGPLPLKIGNLKVLIEIDFSMNNFSGVIPTTIGGLKNLQYLSLGNNRLQGSIPNSVGDLISLKSLNLSNNNLSGAIPVSLEKLTYLKDLDLSFNKLEGEIPNGGSFGNFSAESFEGNQLLCGLPNLHVPPCKTSIHHTSWKNALLLGTFLPVSTIFMIVVMLLIVRYRKRGKQALNDANMPPLAKWRMLSYLELCRATDGFSENNLLGRGGFGSVYKARIEDGMDVAVKVFNLEYGRAFKSFDVECEIMKSIRHRNLIKVISSCSNEEFKALVTEYMPHGSLEKYLYSSNYNLDIFQRLNIMIDVALALEYLHFGCSASVIHCDLKPSNVLLDDNMVAHLSDFGIAKLLTGEDQSMIQTQTLATIGYMAPEYGREGRVSANGDVYSFGIMLMETFTGKKPTDKIFNGEMTLTHWVNNWLPISIMKVADANLISQEDVHFAAKEQCMSFVFNLAMECTAESPEQRINAKEIVTRLLKIKDSLLRNVGGLITLCNNSWGV

SEQ ID NO: 370 - protein, 1039 aa, Citrus unshiu
MERVRSLSMTSRFLLLHCLFLISLFIAAATANTSSITTDQDALLALKAHITHDPTNFLAKNWNTSTPVCNWTGVTCDVHSHRVTVLDIFGLNLIGTVPSQLWNLSSLQSLDLGLNRFRGSIPSAIFTTYTLKYVNFRGNQLSGAFPSLIFNKSSLQHLDFSFNTLSGEIPANICSNLPFLEYFSLSKNMFHGRIPSTLSNCTYLQILSLSYNNFSGAIPKEIGNLTELKELYLSTNRLQGKIPREFSNLADLEQMTLSKNNLQGEIPPEIGNFSNLGWLELGQNKLVGIVPAAIFNVSTLKVLDLENNSLSGRLSSLADVRLPNLVALYLWGNNFCGTIPRFIFNASKLSILELEDNSFSGFIPNTFGNLRNLKVLILYDNYLTSSTPELSFLSTLSNCKSLQHIQLLNNPLDGILSRTSVSNLSHSLEYFDMSDCNVSGGIPEEIGNLTNLTTIFLGGNKLHGSIPFTLGKLQKLQYLGLEDNKLEGSIPNDICHLVELFELELGGNKLSGSIPVCFSNLTSLRILSLDSNELTSIPSTFWNLTDILYLNFSSNFLTGPLPLEIENLKVLVGIDFSMNTFSSVIPTAIGGLENLQSLFLAYNRLQGSIPNSFGDLISLISLNLSNNNLSGSIPISLEKLSYLKDLNLSFNKLEGEIPRRGSFGNFSAESFEGNELLCGSPNLRVPPCKTSIHHKSRKNTLLLGIVLPLSTIFMIVVILLIVKYGKREKGPPNDANMPPEATLRRFSYLELCQATDGFSQNNLIGRGGFGSVYKARIRDGMEVAVKVFNLQCGRAFKSFDVECEIMKSIRHRNLIKVISSCSNEEFKALVLEYMPHGSLEKYLYSSSCILDILQRLNIMIDVASALEYLHFGYSAPIIHCDLKPNNVLLDNNMVAHLSDFGIAKLLTREDQSMTQTQTLATIGYMAPEYGREGRISTNGDVYSFGIMLIETFSGKKPTDEIFNGEMTLKHWVNDWLPISIMEVVDANLLSREDIHFVAKEQCMSFVFNLAMECTVESPEQRINAKEIVRRLLKIRDLLL

SEQ ID NO: 371 - protein, 1171 aa, Citrus sinensis
MESVHSLSIMSRFPLLHYLILISLFIAAETANTRTITTDQDALLALKAHITHDPTNFLAKNWNTSAPVCNWTGVTCDVHSHKVTALNISGLNLTGTIPSQLGNLSSLQSLDLSFNRLSGSIPSAIFTTYTLKDVSFRENQLTGVFPSFIFNKSSLQHLDFSRNTLSGEIPANICSSLPFLDYLYLSKNMLHGGIPSTLSNCTYLRILSLAYNDFSGAVPKDIGNLTKLMGLYLGRNRLQGEIPREFGNLAELEQMSLAENNLQGGIPQELGNLTKLEILELFESNLTGEIPSEIGNLRNLEELDLSHNKLVGTVPAAIFNVSTLKRLGLQNNFLSGCLSSISDARLLNLEGLYLWGNNFSGTIPDFIFNASKLFQLSLAMNSFFGFIPNTFGNLRNLKWLTLYDNYLTSSTPELSFLSSLSNCKSLTHLSLSNNPLDSVLSRTSVSNLSHSLKELYMSNCNVSGGILEEITNLTNLTAINLGDNKLNGSIPITLGKLQKLQYLGLENNKLEGSIPDGICCSVELYKLELGGNKLSGSIPACFSNLASLRILSLDSNKLTSIPLNFWNLKDILYLNFSSNFLTGPLPLEIGNLKVLVGIDLSMNNFSGVIPTEIGGLKNLEYLFLGYNRLQGPIPDSFGDLISLKFLNLSNNNLSGAIPASLEKLSYLENLNLSFNKLEGEIPRGGPFRNFSVESFEGNELLCGSPNLQVPPCKTSNHHTLWKNSLLLRIVLPLSAIFMIVVILLILRYRQKGKRPSNDANMPSIATWRTFSHLELCRATDGFSENNLIGRGGFGSVYKARLGDGMEVAVKVFNLQCGRALKGFDVECEMMKSIRHRNLIKVISTCSNEEFKALVLEYMPHGSLEKYMYSSNYILDIFQRLNIMIDVASALEYLHFGYSAPIIHCDLKPSNVLLDDNMVAHLSDFSIAKLLTGEDQSMTQTQTLATIGYMAPEYGREGRVSTNGDVYSFGIMLMETFTGKKPTNEIFNGEMTLKHWVNDWLPISTMEVVGANLLSQEDIHFVAKEQCVSCVFNLAMECTVESPEQRINAREIDLAYIEQKQKEKLEKGKVVVGARTTKEKGNIWLWLELVVGAGSTKERGNIWLWLELVARARSTKEMKRKIFGCGWSSWLKLDRRRKGKGKYLGGAPGTKKMGNIWQVKTATFLALTKRCV

SEQ ID NO: 372 - protein, 1063 aa, Citrus unshiu
MERVRSLSMTSRFLLLHCLFLISLFIAAATANTSSITTDQDALLALKAHITHDPTNFLAKNWNTSTPVCNWTGVTCDVHSHRVTVLDIFGLNLIGTVPSQLWNLSSLQSLDLGLNRFRGSIPSAIFTTYTLKYVNFRGNQLSGAFPSLIFNKSSLQHLDFSFNTLSGEIPANICSNLPFLEYFSLSKNMFHGRIPSTLSNCTYLQILSLSYNNFSGAIPKEIGNLTELKELYLSTNRLQGKIPREFSNLADLEQMTLSKNNLQGEIPQELGNLTGLETLLLYYNFLTGEIPPEIGNFSNLGWLELGQNKLVGIVPAAIFNVSTLKVLDLENNSLSGRLSSLADVRLPNLVALYLWGNNFCGTIPRFIFNASKLSILELEDNSFSGFIPNTFGNLRNLKVLILYDNYLTSSTPELSFLSTLSNCKSLQHIQLLNNPLDGILSRTSVSNLSHSLEYFDMSDCNVSGGIPEEIGNLTNLTTIFLGGNKLHGSIPFTLGKLQKLQYLGLEDNKLEGSIPNDICHLVELFELELGGNKLSGSIPVCFSNLTSLRILSLDSNELTSIPSTFWNLTDILYLNFSSNFLTGPLPLEIENLKVLVGIDFSMNTFSSVIPTAIGGLENLQSLFLAYNRLQGSIPNSFGDLISLISLNLSNNNLSGSIPISLEKLSYLKDLNLSFNKLEGEIPRRGSFGNFSAESFEGNELLCGSPNLRVPPCKTSIHHKSRKNTLLLGIVLPLSTIFMIVVILLIVKYGKREKGPPNDANMPPEATLRRFSYLELCQATDGFSQNNLIGRGGFGSVYKARIRDGMEVAVKVFNLQCGRAFKSFDVECEIMKSIRHRNLIKVISSCSNEEFKALVLEYMPHGSLEKYLYSSSCILDILQRLNIMIDVASALEYLHFGYSAPIIHCDLKPNNVLLDNNMVAHLSDFGIAKLLTREDQSMTQTQTLATIGYMAPEYGREGRISTNGDVYSFGIMLIETFSGKKPTDEIFNGEMTLKHWVNDWLPISIMEVVDANLLSREDIHFVAKEQCMSFVFNLAMECTVESPEQRINAKEIVRRLLKIRDLLL

SEQ ID NO: 373 - protein, 985 aa, Citrus unshiu
MERAHSLMMMSRFLLLHCLILISLFIAAATANTSSTITDQDALLALKAHITHDPTNFLAKNWNTSTPVCNWTGVACEVHSQRVTVLNISSLNLTGTIPSQLGNLSSLQSLNLSFNRLFGSIPSAIFTTYTLKYVCLRGNQLSGTFPSFISNKSSLQHLDLSSNALSGEIRANICREIPREFGNLPELELMSLAANNLQGKIPLKIGNLRNLEKLDIGDNKLVGIAPIAIFNVSTLKILGLQDNSLSGCLSSIGYARLPNLEILSLWGNNFSGTIPRFIFNASKLSILDLEGNSFSGFIPNTFGNLRNLSWLVLSDNYLTSSTQELSFLSSLSNCKFLKYFDLSYNPLYRILPRTIVGNLSHSLEEFKMSNCNISGGIPEEISNLTNLRTIYLGGNKLNGSILITLSKLQKLQDLGLKDNKLEGSIPYDICNLAELYRLDLDGNKLSGSIPACFSNLTSLRIVSLGSNELTSIPLTFWNLKDILNLNFSSNFLTGSLPLEIGSLKVLVGIDLSRNNFSGVIPTEIGGLKNLEYLFLGYNRLQGSIPNSFGDLISLKFLNLSNNNLSGVIPASLEKLSYLEDLNLSFNQLEGKIPRGGSFGNFSAQSFEGNELLCGSPNLQIPPCKTSIHHKSWKKSILLGIVLPLSTTFMIVVILLILRYRQRGKRPSNDANGPLVASRRMFSYLELCRATDGFSENNLIGRGGFGFVYKASLGDGMEVAVKVFTSQCGRAFKSFDVECEIMKSIRHRNLIKVISSCSNEEFKALVLEYMPHGSLEKYLYSSNCILDIFQRLNIMIDVASALEYLHFGYSAPVIHCDLKPSNVLLDDNMVAHLSDFSIAKMLTGEDQSMIQTQTLATIGYMAPEYGREGRVSANGDVYSFGIMLMETFTGKKPTDEIFNGEMTLKHWVNNWLPISTMEVVDANLLSQEDIHFVAKEQCVSFVFNLAMECTMEFPKQRINAKEIVTKLLKIRDSLLRNVGGRCVMKF

SEQ ID NO: 374 - protein, 1050 aa, Citrus unshiu
MERAHSLMMMSRFLLLHCLILISLFIAAATANTSSTITDQDALLALKAHITHDPTNFLAKNWNTSTPVCNWTGVACEVHSQRVTVLNISSLNLTGTIPSQLGNLSSLQSLNLSFNRLFGSIPSAIFTTYTLKYVCLRGNQLSGTFPSFISNKSSLQHLDLSSNALSGEIRANICSNLPFLEYLAFFKNMLHGGIPSTLSNCTYLRTLDFSYNDFSEAIPKDIGNLTNLKELYLGRNRLQGEIPREFGNLPELELMSLAANNLQGKIPLKIGNLRNLEKLDIGDNKLVGIAPIAIFNVSTLKILGLQDNSLSGCLSSIGYARLPNLEILSLWGNNFSGTIPRFIFNASKLSILDLEGNSFSGFIPNTFGNLRNLSWLVLSDNYLTSSTQELSFLSSLSNCKFLKYFDLSYNPLYRILPRTIVGNLSHSLEEFKMSNCNISGGIPEEISNLTNLRTIYLGGNKLNGSILITLSKLQKLQDLGLKDNKLEGSIPYDICNLAELYRLDLDGNKLSGSIPACFSNLTSLRIVSLGSNELTSIPLTFWNLKDILNLNFSSNFLTGSLPLEIGSLKVLVGIDLSRNNFSGVIPTEIGGLKNLEYLFLGYNRLQGSIPNSFGDLISLKFLNLSNNNLSGVIPASLEKLSYLEDLNLSFNQLEGKIPRGGSFGNFSAQSFEGNELLCGSPNLQIPPCKTSIHHKSWKKSILLGIVLPLSTTFMIVVILLILRYRQRGKRPSNDANGPLVASRRMFSYLELCRATDGFSENNLIGRGGFGFVYKASLGDGMEVAVKVFTSQCGRAFKSFDVECEIMKSIRHRNLIKVISSCSNEEFKALVLEYMPHGSLEKYLYSSNCILDIFQRLNIMIDVASALEYLHFGYSAPVIHCDLKPSNVLLDDNMVAHLSDFSIAKMLTGEDQSMIQTQTLATIGYMAPEYGREGRVSANGDVYSFGIMLMETFTGKKPTDEIFNGEMTLKHWVNNWLPISTMEVVDANLLSQEDIHFVAKEQCVSFVFNLAMECTMEFPKQRINAKEIVTKLLKIRDSLLRNVGGRCVMKF

SEQ ID NO: 375 - protein, 1101 aa, Citrus unshiu
MERVHSLSMISRFLLLHCLVLIFLFIAAATANTSTITTDQDALLALKAHISHDPTNFLAKNWNKSTPICNWTGVTCDVHSHRVTVLNISSLNLTGTVPAQLGNLSSLQSLDLSFNRLSGFIPSTIFTMYTLKRVSFRENQLSGTFPSFIFNKSSLQHLDFSHNTLSGEIPANICSNLPFLEYISLSQNMFHGRIPPTLSNCTYLRILGLSLNNFSGAIPKEISYLTKLKELYLGVNRLQGEIPREVGNLAELELMSLPENKLQGEIPQELGNLVGLEFLFLSDNFLTGTIPKEISNFTNLQDLGLDSNRLQGEIPPEIGNLRSLEWLLLGYNKLVGTIPAAIFNVSTLKQLDLQNNSLSGSLSSIADVRLPNLEMIYMWGNNFSGTIPRFIFNASKLSILSLEKNSFSGFIPNTFGNLRNLEQLDLSDNYLTSSTPELSFLSSLSNCKSLTHIRLSDNPLNGILPRTTVGNLSHSLELFDMSYCNISGSIPKEISNLTNLTTIYLVGNKLNGLIPITLGKLQKLQSLVLEDNKLKGSIPDDICRLAELYELNLGGNKLSGSIPACFSNLASLRTLSLSSNELTSIPLTLWNLKDILYLNFSSNFLSGPLPLEIENLKVLVGIDFSMNNFSSVIPTTIGSLKDLQYLLLAYNKLQGSIPDSVGDLISLKSLNLSNNNLSGAIPVSLEKVSYLENLDLSFNKLEGEIPKGGSFGNFSAESFEGNELLCGSPNLQVPPCKISIHHASRKNALLLGTALPLSTIFMIVVILLILKCRKRRKRPSDDANIPPVPTLRRFSYLELYQATNGFGENNLIGRGGFGSVYKARIQDGIEVAVKVFNLQCGRAFKSFDVECQVMKSIRHRNLIKVISSCSNEEFKALVLEYMPHGSLEKYLYSSNCILDIFQRLNIMIDVASALEYLHFGYSTPVIHCDLKPNNVLLDNNMVAHLSDFGIAKLLTGEDQFVTQTQTLATIGYMAPEYGREGRVSTNGDVYSFGIMLMETFTGKKPTDKIFNGEMTLKRWICDWIPISIMEVVDANLLSREDIHFVAKEQCLSFVFNLAMDCTVECPEQRINAKEIVTRLLKIRDSLLRNVEGRCIRQSNLN

SEQ ID NO: 376 - protein, 789 aa, Citrus sinensis
KIPLKIGNLRNLEKLDIGDNKLVGIAPIAIFNVSTLKILGLQDNSLSGCLSSIGYARLPNLEILSLWGNNFSGTIPRFIFNASKLSILDLEGNSFSGFIPNTFGNLRNLSWLVLSDNYLTSSTQELSFLSSLSNCKFLKYFDLSYNPLYRILPRTTVGNLSHSLEEFKMSNCNISGGIPEEISNLTNLRTIYLGGNKLNGSILITLSKLQKLQDLGLKDNKLEGSIPYDICNLAELYRLDLDGNKLSGSIPACFSNLTSLRIVSLGSNELTSIPLTFWNLKDILNLNFSSNFLTGSLPLEIGSLKVLVGIDLSRNNFSGVIPTEIGGLKNLEYLFLGYNRLQGSIPNSFGDLISLKFLNLSNNNLSGVIPASLEKLSYLEDLNLSFNQLEGKIPRGGSFGNFSAQSFEGNELLCGSPNLQIPPCKTSIHHKSWKKSILLGIVLPLSTTFMIVVILLILRYRQRGKRPSNDANGPLVASRRMFSYLELCRATDGFSENNLIGRGGFGSVYKASLGDGMEVAVKVFTSQCGRAFKSFDVECEIMKSIRHRNLIKVISSCSNEEFKALVLEYMPHGSLEKYLYSSNCILDIFQRLNIMIDVASALEYLHFGYSAPVIHCDLKPSNVLLDDNMVAHLSDFSIAKMLTGEDQSMIQTQTLATIGYMAPEYGREGRVSANGDVYSFGIMLMETFTGKKPTDEIFNGEMTLKHWVNDWLPISTMEVVDANLLSQEDIHFVAKEQCVSFVFNLAMECTMEFPKQRINAKEIVTKLLKIRDSLLRNVGGRCVRQSNLN

SEQ ID NO: 377 - protein, 1077 aa, Citrus unshiu
MERVHSLSMISRFLLLHCLVLIFLFIAAATANTSTITTDQDALLALKAHISHDPTNFLAKNWNKSTPICNWTGVTCDVHSHRVTVLNISSLNLTGTVPAQLGNLSSLQSLDLSFNRLSGFIPSTIFTMYTLKRVSFRENQLSGTFPSFIFNKSSLQHLDFSHNTLSGEIPANICSNLPFLEYISLSQNMFHGRIPPTLSNCTYLRILGLSLNNFSGAIPKEISYLTKLKELYLGVNRLQGEIPREVGNLAELELMSLPENKLQGEIPQELGNLVGLEFLFLSDNFLTGEIPPEIGNLRSLEWLLLGYNKLVGTIPAAIFNVSTLKQLDLQNNSLSGSLSSIADVRLPNLEMIYMWGNNFSGTIPRFIFNASKLSILSLEKNSFSGFIPNTFGNLRNLEQLDLSDNYLTSSTPELSFLSSLSNCKSLTHIRLSDNPLNGILPRTTVGNLSHSLELFDMSYCNISGSIPKEISNLTNLTTIYLVGNKLNGLIPITLGKLQKLQSLVLEDNKLKGSIPDDICRLAELYELNLGGNKLSGSIPACFSNLASLRTLSLSSNELTSIPLTLWNLKDILYLNFSSNFLSGPLPLEIENLKVLVGIDFSMNNFSSVIPTTIGSLKDLQYLLLAYNKLQGSIPDSVGDLISLKSLNLSNNNLSGAIPVSLEKVSYLENLDLSFNKLEGEIPKGGSFGNFSAESFEGNELLCGSPNLQVPPCKISIHHASRKNALLLGTALPLSTIFMIVVILLILKCRKRRKRPSDDANIPPVPTLRRFSYLELYQATNGFGENNLIGRGGFGSVYKARIQDGIEVAVKVFNLQCGRAFKSFDVECQVMKSIRHRNLIKVISSCSNEEFKALVLEYMPHGSLEKYLYSSNCILDIFQRLNIMIDVASALEYLHFGYSTPVIHCDLKPNNVLLDNNMVAHLSDFGIAKLLTGEDQFVTQTQTLATIGYMAPEYGREGRVSTNGDVYSFGIMLMETFTGKKPTDKIFNGEMTLKRWICDWIPISIMEVVDANLLSREDIHFVAKEQCLSFVFNLAMDCTVECPEQRINAKEIVTRLLKIRDSLLRNVEGRCIRQSNLN

SEQ ID NO: 378 - protein, 698 aa, Citrus clementina
MNSFSGFIPSTFGNLRNLEWLTLYDNNLTSSTLDLSFLSSLSNCKSLTHISLSNNPLDGILPRTYVGNLSHSLKNFYMYNCNVSGGIPEEITNLTDLTTIVLGGNKLNGSIPITLGKLQKLQDVDLEYNQLEGSIPDSICLSVELYELELGGNKLSGSIPACFSNMTFLKVLSLGSNELTSIPLNFWSLKDILDLNLSSNCFSGPLPLEIRNLKALIEIDFSMNNFSGIIPMEIGSLKNLENLFLEYNRLEGSIPDSFGDLISLKSLNLSYNNLSGTIPVSLEKLSYLKDLNLSFNKLKGEIPRGGSFGNFSAESFKGNELLCGSPNLQVPPCKASIHRTSRKNALILGIVLPFSTIFMTAIILFIIKYQKREKGPPNDPNMPPVATWRRFSYLELFQATDKFSENNLIGRGGFGSVYKARIRDGMEVAVKVFNLQCGRAFKSFDVECAMMKSIRHRNLVKVISSCSNEEFKALVLEYMPHGSLEKYLHSSNYSLDIFQRLNIMIDVASALEYLHFGYSAPVIHCDLKPSNVLLDDNMVAHLSDFGIAKLLTGEDQSMTQTQTLATIGYMAPEYGREGQVSTNGDVYSFGIMLMETFTRKKPTDELFNGEMTLKHWVNDCLPISTMEVVDANLLSQEDIHFVAKEQCVSFVFNLALECTVESPEQRINAKEIVAKLLKIRDSLLRNVGGRCIRQSNLN

SEQ ID NO: 379 - protein, 1065 aa, Citrus sinensis
MERLHSLRMMSRFLLLHCLILISLFIAAATANTSSTITDRDALLALKAHITHDPTNFLAKNWNTSTPVCNWTGVACDVHSHRVTVLNISSLNLTGTIPSQLGNLSSLQSLNLSCNRLFGSIPSAIFTIYTLKYVSLRENQVSGQIPANICSNLPFLDYLSLGKNMFHGGIPSALSNCTYLQILHLSYNDFSGAVPKDIGNLSKLKELYLGRNRLQGEIPREFVNLTELERMSLSENELQGGIPRELGNLTKLEGLQLFRNNLTGGIPRELGNLTKLERLQLFWNNLTGAIPKEIGNLTKLKELSLDGNRLQGEIPLEISNLQNLEELDLRHNKLVGTVPAAIFNMSMLKLLHLQNNSLLGCLSSIADVRLPNLEALLLWGNNFSGTIPRFIFNASKLSILELSQNSFSGFIPNTFGNLRNLEWLNLRDNYLTSSTPELSFLSSLSNCKSLTFIHLSDNPLDGILSKTSIGGNKLNGSIPITLSKLQKLQGLGLDDNKLEGSIPDSICRLTELYELELGGNKLFGSIPACFSNLASLRILSLSSNELTSIPLTFWNLKDILQLNFSSNFLTGPLPLEIGNLKVLIGIDFSMNNFSSVIPTEIGGLKNLEYLFLGYNRLEGSIPDSFGDLISLKFLNLSNNNLSGAIPTSLEKLSYLEDLNLSFNKLEGEIPRGGSFGNFAAESFEGNELLCGSPTLQVLPCKTSIHHTSWKNSLLLGIVLPLSTTLLIVVIWLILRYRKRGKQPSNDANMPLVATWRTFSYLELCRATNGFSENNLIGRGGFGSVYKARLGDGMEVAVKVFNLQCGRAFKSFAVECEMMKSIRHRNLIKVISSCSNEEFKALVLEYKPHGSLEKYLYSSNCILDIFQRLNIMIDVASALEYLHFGCSAPVIHCDLKPDNVLLDDNLVAYLSDFGIAKLLIGEDQSMTQTQTLATIGYMAPEYGREGRVSTNGDVYSFGIMLMETFTGKKPTDEIFNGEMTLKHWVNDWLPISTMEVVDANLLSQEDVHFVAKEQCVSFVFNLAMACTVESHEQRINAKEIVTKLLKIRDSLLRNVGGRRISQPNLN

SEQ ID NO: 380 - protein, 824 aa, Citrus sinensis
MPSIINNFLTSTTPKEIDNISNLKVLYLYNNRLQGEIIHEIGHLHNLGFLDLSQNKLLGTIPAAIFNVSTLKAFAVTNNSLSGCLSSITDVGLPNLEVLYLWGNNFSGTIPHFIFNASKLSKLALEMNSFSGFIPSTFGNLRNLEWLTLYDNNLTSSTLDLSFLSSLSNCKSLTHISLSNNPLDGILPRTYVGNLSHSLKNFYMYNCNVSGGIPEEITNLTDLTTIVLGGNKLNGSIPITLGKLQKLQDVDLEYNQLEGSIPDSICLSVELYELELGGNKLSGSIPACFSNMTFLKVLSLGSNELTSIPLNFWSLKDILDLNLSSNCFSGPLPLEIRNLKALIEIDFSMNNFSGIIPMEIGSLKNLENLFLEYNRLEGSIPDSFGDLISLKSLNLSYNNLSGTIPVSLEKLSYLKDLNLSFNKLKGEIPRGGSFGNFSAESFKGNELLCGSPNLQVPPCKASIHRTSRKNALILGIVLPFSTIFMTAIILFIIKYQKREKGPPNDPNMPPVATWRRFSYLELFQATDKFSENNLIGRGGFGSVYKARIRDGMEVAVKVFNLQCGRAFKSFDVECAMMKSIRHRNLVKVISSCSNEEFKALVLEYMPHGSLEKYLHSSNYSLDIFQRLNIMIDVASALEYLHFGYSAPVIHCDLKPSNVLLDDNMVAHLSDFGIAKLLTGEDQSMTQTQTLATIGYMAPEYGREGQVSTNGDVYSFGIMLMETFTRKKPTDELFNGEMTLKHWVNDCLPISTMEVVDANLLSQEDIHFVAKEQCVSFVFNLALECTVESPEQRINAKEIVAKLLKIRDSLLRNVGGRCIRQSNLN

SEQ ID NO: 381 - protein, 843 aa, Citrus unshiu
MHKDSKVWTILAPQENCQEGGVGSANYSKISKGDTDILADDLQVAMKENIHELIVVGCQREEYSIYDLLYLTVRYHMKSLSDNKLVGVVPATIFNLSTLRVFAVSNNSLLGSLQSSADVQLPNLEGIYLWGNNFSGTIPSFIFNASKLSTLALEDNSFFGFIPNTFGNLGNLRWFNIENNYLTSSTPELNFLSSLSNSKYLKVLELSYNPLNGILPRTSMGNLSHSLEKFVMINCNVGGAIPEEISNLTNLRMIGFSGNKLNGSIPITLCKLQKLQLLSFRDNKLEGSIPEDVCSLAELYQLHLGGNKFSRSIPTCIGNLTSLRTLSLGSNELISVIPSTLWNLEYIMNLNFSSNFLTGPLPLEIGNLKVLVGIDFSMNNFSGAIPTTIGGLTDLQYLLLGHNKLEGSIPNPIGDLISLEYLDLSNNNLSGPIHVSLEKLLYLKDLNLSFNNLEGEIPKGGSFRNFSAKSFEGNKLLCGSPNLQVPPCKTSIHHTSRKNALLLGIVLPLSIVSMIVVILLISRYRKRGKQLPNDANMPPVATWFKLFQATDGFSENNLIGRGSFGSVYKARIQDGMEVAVKVFHLQCGGVFKSFDVECEVMKSIRHRNLIKIISTCSNDDFKALVLEYMPHGSLEKCLYSSNCILDIFQRLNIMIDIAVALEYLHFGYSAPVIHCDLKPSNVLLDDNMVAHLSDFGIAKLLTGEDQSKSQTQTLATIGYMAPEYGREGRVSTNGDVYSFGIMLMETFTKKKPTDKIFAGEMTLKYWVSNLLPISVMEIVDANLLSREDKHFAAKEQCVSFVFNFAMECTVESAEQRINAKEIVTRLLKIRDSLLICTRESKLN

SEQ ID NO: 382 - protein, 972 aa, Citrus unshiu
MSRSLLRHCLILISLFIAAATANTSTTTADQDGLLALKAHITHDPTNFLAKNWNTRTLVCNWTGVTCDVHSHRVTILNISRLNLTGTIPSQLGNLSSLQSLDLSFNQLSGSIPSAIFSTYTLKYVNFRENQLSGAFPSLIFNKSSLQLLDFAHNTLSDEIPANICREIPQEFGNLAELEQMSLSENKLQGEIPHEIGNLRNLELLVLSHNRLVGVIPTKVFNVSTLKVFEVSNNSLSGSLSSIAGVRLPNLEVLRMRSNNFCGTIPHFIFNASKLSLLELGDNSFSGFIPDTFGNLRNLNKVTLYNNYLTSSTSDLNFLSSLSNCKTLTYIDLSDNPLDGILPGTSVGNLSHSLEYFYMPNCNVSGGIPEEISNLTNLIIIYLGGNKLNGSIPITLSKLQKLQGLSLADNKLEGSIPNNICRLTELYELDLGSNKFSRSIPACFSNLASLRTLSLGSNELTSIPLTFWNLKDILYLNFSSNFLTGPLPLEIENLKVLVGIDFSVNNFSGVIPTTIGSLKGLQYLFVGYNRLQGSIPYSIGDLISLKSLNLSNNNLSGTIPVSLEKLSYLEDLNLSFNKLAGEIPRGGSFGNFSAESFEGNELLCGSPNLRVPPCKTSTHHTSWKNALLLGTVLPLSTIFMIVVILLILRYRKRVKPPPNDANMPPVATWRRFSYLELCRATDRFSENNLIGRGGFGSVYKARIQDGMEVAVKVFHLHCSGAFKSFDVECNVMKNIRHRNLIKIISSCSNDDFKALVLEYMPHGSLEKCLYSSNCILDIFQRLSIMVDVASALEYLHFNYSAPIIHCDLKPSNVLLDDNMVAHLSDFGIAKLLIGEDQSMTQTQTLATIGYMAPEYGREGRVSTNGDVYSFGIMLIEAFTRKKPTDEMFSGEMTLKRWINDLLSVSVMEVVDANLLTREDRHFAAKQQCVSFVFNLAMECTIESPERRINAKEIVTELSKIRDSLFRNVGADE

SEQ ID NO: 383 - protein, 1044 aa, Citrus unshiu
MERVHSLSMMSRSLLRHCLILISLFIAAATANTSTTTADQDGLLALKAHITHDPTNFLAKNWNTRTLVCNWTGVTCDVHSHRVTILNISRLNLTGTIPSQLGNLSSLQSLDLSFNQLSGSIPSAIFSTYTLKYVNFRENQLSGAFPSLIFNKSSLQLLDFAHNTLSDEIPANICSNLPFLEILSLSQNMFHGGIPSTLSNCTYLQKLSLPYNDFSGAIPKEIGNLNKLKRLYLGRNRLQGEIPQEFGNLAELEQMSLSENKLQGEIPHEIGNLRNLELLVLSHNRLVGVIPTKVFNVSTLKVFEVSNNSLSGSLSSIAGVRLPNLEVLRMRSNNFCGTIPHFIFNASKLSLLELGDNSFSGFIPDTFGNLRNLNKVTLYNNYLTSSTSDLNFLSSLSNCKTLTYIDLSDNPLDGILPGTSVGNLSHSLEYFYMPNCNVSGGIPEEISNLTNLIIIYLGGNKLNGSIPITLSKLQKLQGLSLADNKLEGSIPNNICRLTELYELDLGSNKFSRSIPACFSNLASLRTLSLGSNELTSIPLTFWNLKDILYLNFSSNFLTGPLPLEIENLKVLVGIDFSVNNFSGVIPTTIGSLKGLQYLFVGYNRLQGSIPYSIGDLISLKSLNLSNNNLSGTIPVSLEKLSYLEDLNLSFNKLAGEIPRGGSFGNFSAESFEGNELLCGSPNLRVPPCKTSTHHTSWKNALLLGTVLPLSTIFMIVVILLILRYRKRVKPPPNDANMPPVATWRRFSYLELCRATDRFSENNLIGRGGFGSVYKARIQDGMEVAVKVFHLHCSGAFKSFDVECNVMKNIRHRNLIKIISSCSNDDFKALVLEYMPHGSLEKCLYSSNCILDIFQRLSIMVDVASALEYLHFNYSAPIIHCDLKPSNVLLDDNMVAHLSDFGIAKLLIGEDQSMTQTQTLATIGYMAPEYGREGRVSTNGDVYSFGIMLIEAFTRKKPTDEMFSGEMTLKRWINDLLSVSVMEVVDANLLTREDRHFAAKQQCVSFVFNLAMECTIESPERRINAKEIVTELSKIRDSLFRNEID

SEQ ID NO: 384 - protein, 1077 aa, Citrus sinensis
MERVHSLSMMSRFLFLHCLILISLLTAAATANTSSITTDQDALLALKAHITHDPTNFLAKNWNTSTPVCNWTGVTCDVHSHRVKVLNISHLNLTGTIPSQLWNLSSLQSLNLGFNRLSGSIPSAIFTLYTLKYVNFRGNQLSGAFPSFIFNKSSLQHLDFSYNALSGEIPANICSNLPFLESISLSQNMFHGRIPSALSNCKYLEILSLSINNLLGAIPKEIGNLTKLKELYLGYSGLQGEIPREFGNLAELELMALQVSNLQGEIPQELANLTGLEVLKLGKNFLTGEIPPEIHNLHNLKLLDLSHNKLVGAVPATIFNMSTLTRLGLQSNSLSGSLSSIADVQLPNLEELRLWSNNFSGTIPRFIFNASKLSVLELGRNSFSGFIPNTFGNLRNLRLMTLHYNYLTSSNLELSFLSSFSNCKSLTYIGLSNNPLDGILPRMSMGNLSHSLEYFDMSYCNVSGGFPKEIGNLTNLIGIYLGGNKLNGSIPITLGKLQKLQGLHLEDNKLEGPIPDNICRLTKLYELELSGNKLSGSIPACFSNLASLGTLSLGSNKLTSIPLTIWNLKGMLYLNFSSNFFTGPLPLDIGNLKVLVGIDFSMNNFSDVIPTAIGGLTNLQYLFLGYNRLQGSIPESFGDLISLKSLNLSNNNLSGSIPISLEKLSYLEYLDLSFNKLKGEIPKGGSFGNFSAESFEGNELLCGSPNLQVPPCKTSIHHKSRKNVLLLGIVLPLSTIFIIVVILLIVRYRKRVKQPPNDANMPPIATCRRFSYLELCRATNRFSENNLIGRGGFGSVYKARIGEGMEVAVKVFDLQCGRAFKSFDVECEMMKSIRHRNLIKVISSCSTEEFKALILEYMPHGSLEKSLYSSNYILDIFQRLNIMVDVATTLEYLHFGYSAPVIHCDLKPSNVLLDDNMVAHLSDFGIAKLLIGEDQSITQTQTLATIGYMAPEYGREGRISRNGDVYSFGIILMETFTGKKPTDEIFNEEMTLKHWVNDWLPISIMKVIDANMLSREDIHFVAKEQCVSFVFNLAMECTVESPQQRINAKEIVTRLLKIRDSLLRNVGGRCIRQSNLN

SEQ ID NO: 385 - protein, 1063 aa, Citrus sinensis
MERAHSLMMMSRFLLLHCLILISLFIAAATANTSSTITDQDALLALKAHITHDPTNFLAKNWNTSTPVCNWTGVACEVHSQRVTVLNISSLNLTGTIPSQLGNLSSLQSLNLSFNRLFGSIPSAIFTTYTLKYVCLRGNQLSGTFPSFISNKSSLQHLDLSSNALSGEIRANICSNLPFLEYLAFFKNMLHGGIPSTLSNCTYLRTLDFSYNDFSEAIPKDIGNLTNLKELYLGRNRLQGEIPREFGNLPELELMSLAANNLQGGIPHELGNLAKLEILELFENNLTGKIPLKIGNLRNLEKLDIGDNKLVGIAPIAIFNVSTLKILGLQDNSLSGCLSSIGYARLPNLEILSLWGNNFSGTIPRFIFNASKLSILDLEGNSFSGFIPNTFGNLRNLSWLVLSDNYLTSSTQELSFLSSLSNCKFLKYFDLSYNPLYRILPRTTVGNLSHSLEEFKMSNCNISGGIPEEISNLTNLRTIYLGGNKLNGSILITLSKLQKLQDLGLKDNKLEGSIPYDICNLAELYRLDLDGNKLSGSIPACFSNLTSLRIVSLGSNELTSIPLTFWNLKDILNLNFSSNFLTGSLPLEIGSLKVLVGIDLSRNNFSGVIPTEIGGLKNLEYLFLGYNRLQGSIPNSFGDLISLKFLNLSNNNLSGVIPASLEKLSYLEDLNLSFNQLEGKIPRGGSFGNFSAQSFEGNELLCGSPNLQIPPCKTSIHHKSWKKSILLGIVLPLSTTFMIVVILLILRYRQRGKRPSNDANGPLVASRRMFSYLELCRATDGFSENNLIGRGGFGSVYKASLGDGMEVAVKVFTSQCGRAFKSFDVECEIMKSIRHRNLIKVISSCSNEEFKALVLEYMPHGSLEKYLYSSNCILDIFQRLNIMIDVASALEYLHFGYSAPVIHCDLKPSNVLLDDNMVAHLSDFSIAKMLTGEDQSMIQTQTLATIGYMAPEYGREGRVSANGDVYSFGIMLMETFTGKKPTDEMFNGEMTLKHWVNDWLPISTMEVVDANLLSQEDIHFVAKEQCVSFVFNLAMECTMEFPKQRINAKEIFVFRGKVDYALS

SEQ ID NO: 386 - protein, 1077 aa, Citrus unshiu
MERVHSLSMMSRFILLHCLILISLLTAAATANTSSITTDQDALLALKAHITHDPTNFLAKNWNTSTPVCNWTGVTCDAHRHRVKVLNISHLNLTGTIPSQLWNLSSLQSLNLGFNRLSGSIPSAIFTMYTLKYVNFRGNQLSGAFPSFIFNKSSLQRLDFSYNALSGEIPANICSNLPFLEYFSLSQNMFHGGIPSTLSNCKYLEILSLSINNLLGAIPKEIGNLTKLKELYLGYSGLQGEIPREFGNLAELELMALQVSNLQGEIPQELANLTGLEVLQLDKNFLTGEIPPEIHNLHNLKLLDLSHNKLVGAVPATIFNMSTLTGLGLQSNSLSGSLSSIADVQLPNLEELRLWSNNFSGTIPRFIFNASKLSVLELGINSFSGFIPNTFGNLRNLRLLTLHYNYLTSSNLELSFLSSFSNCKSLTYIGLSNNPLDGILPRMSMGNLSHSLEYFDLSYCNVSGGFPEEIGNLTNLIGIYLGGNKLNGSIPITLGKLQKLQGLHLEDNKLEGPIPDDICRLTKLYELELSGNKLSGSIPACFSNLASLGTLSLGSNKLTSIPLTIWNLKGMLYLNFSSNFFTGPLPLDIGNLKVLVGIDFSMNNFSDVIPTVIGGLTNLQYLFLGYNRLQGSIPESFGDLISLKSLNLSNNNLSGSIPISLEKLSYLEDLDLSFNKLKGEIPKGGSFGNFSAESFEGNELLCGSPNLQVPPCKTSIHHKSRKNVLLLGIVLPLSTIFIIVVILLIVRYRKRVKQPPNDANMPPIATCRRFSYLELCRATDRFSENNLIGRGGFGSVYKARIGEGMEVAVKVFDLQCGRAFKSFDVECEIMKSIRHRNLIKVISSCSTEEFKVLVLEYMPHGSLEKNLYSSNCILDIFQRLNIMVDVATALEYLHFGYSAPVIHCDLKPSNVLLDDNMVAHLSDFGIAKLLIGEDQSMTQTQTLATIGYMAPEYGREGRISTNGDVYSFGIILMETFTGKKPTDEIFNEEMTLKHWVNDWLPISIMKVIDANLLSWEDIHFVAKEQCVSFVFNLAMECTVESPQQRINAKEIVTRLLKIRDSLLRNVGGRCIRQSNLN

SEQ ID NO: 387 - protein, 982 aa, Citrus sinensis
MERVHSLSMMSRFLFLHCLILISLLTAAATANTSSITTDQDALLALKAHITHDPTNFLAKNWNTSTPVCNWTGVTCDVHSHRVKVLNISHLNLTGTIPSQLWNLSSLQSLNLGFNRLSGSIPSAIFTLYTLKYVNFRGNQLSGAFPSFIFNKSSLQHLDFSYNALSGEIPANICSNLPFLESISLSQNMFHGRIPSALSNCKYLEILSLSINNLLGAIPKEIGNLTKLKELYLGYSGLQGEIPREFGNLAELELMALQVSNLQGEIPQELANLTGLEVLKLGKNFLTGEIPPEIHNLHNLKLLDLSHNKLVGAVPATIFNMSTLTGLGLQSNSLSGSLSSIADVQLPNLEELRLWSNNFSGTIPRFIFNASKLSVLELGRNSFSGFIPNTFGNLRNLRLMTLHYNYLTSSNLELSFLSSFSNCKSLTYIGLSNNPLDGILPRMSMGNLSHSLEYFDMSYCNVSGGFPKEIGNLTNLIGIYLGGNKLNGSIPITLGKLQKLQGLHLEDNKLEGPIPDDICRLTKLYELGLSGNKLSGSIPACFSNLASLGTLSLGSNKLTSIPLTIWNLKGMLYLNFSSNFFTGPLPLDIGNLKVLIGIDFSTNNFSDVIPTVIGGLTNLQYLFLGYNRLQGSISESFGDLISLKSLNLSNNNLSRSIPISLEKLSYLEDLDLSFNKLKGEIPKGGSFGNFSAKSFEGNELLCGSPNLQVPPCKTSIHHKSRKNVLLLGIVLPLSTIFIIVVILLIVRYRKRVKQPPNDANMPPIATCRRFSYLELCRATNRFSENNLIGRGGFGSVYKARIGEGMEVAVKVFDLQCGRAFKSFDVECEMMKSIRHRNLIKVISSCSTEEFKALILEYMPHGSLEKSLYSSNYILDIFQRLNIMVDVATTLEYLHFGYSAPVIHCDLKPSNVLLDDNMVAHLSDFGIAKLLIGEDQSITQTQTLATIGYMAPGLFHVKYILFVVNFLTSYSFLMIFIGRGNYY

SEQ ID NO: 388 - protein, 957 aa, Citrus sinensis
MERLHSLRMMSRFLLLHCLILISLFIAAATANTSSTITDRDALLALKAHITHDPTNFLAKNWNTSTPVCNWTGVACDVHSHRVTVLNISSLNLTGTIPSQLGNLSSLQSLNLSCNRLFGSIPSAIFTIYTLKYVSLRENQVSGQIPANICSNLPFLDYLSLGKNMFHGGIPSALSNCTYLQILHLSYNDFSGAVPKDIGNLSKLKELYLGRNRLQGEIPREFVNLTELERMSLSENELQGGIPRELGNLTKLEGLQLFRNNLTGGIPRELGNLTKLERLQLFWNNLTGAIPKEIGNLTKLKELSLDGNRLQGEIPLEISNLQNLEELDLRHNKLVDVRLPNLEALLLWDNPLDGILSKTSIGGNKLNGSIPITLSKLQKLQGLGLDDNKLEGSIPDSICRLTELYELELGGNKLFGSIPACFSNLASLRILSLSSNELTSIPLTFWNLKDILQLNFSSNFLTGPLPLEIGNLKVLIGIDFSMNNFSSVIPTEIGGLKNLEYLFLGYNRLEGSIPDSFGDLISLKFLNLSNNNLSGAIPTSLEKLSYLEDLNLSFNKLEGEIPRGGSFGNFAAESFEGNELLCGSPTLQVLPCKTSIHHTSWKNSLLLGIVLPLSTTLLIVVIWLILRYRKRGKQPSNDANMPLVATWRTFSYLELCRATNGFSENNLIGRGGFGSVYKARLGDGMEVAVKVFNLQCGRAFKSFAVECEMMKSIRHRNLIKVISSCSNEEFKALVLEYKPHGSLEKYLYSSNCILDIFQRLNIMIDVASALEYLHFGCSAPVIHCDLKPDNVLLDDNLVAYLSDFGIAKLLIGEDQSMTQTQTLATIGYMAPEYGREGRVSTNGDVYSFGIMLMETFTGKKPTDEIFNGEMTLKHWVNDWLPISTMEVVDANLLSQEDVHFVAKEQCVSFVFNLAMACTVESHEQRINAKEIVTKLLKIRDSLLRNVGGRRISQPNLN

What is claimed is:

1. A method of providing a plant with enhanced resistance to a disease, which comprises decreasing expression of a polypeptide encoded by an endogenous nucleic acid sequence in the plant, wherein:

the plant is potato;

the disease is caused by *Candidatus Liberibacter solanacearum* (CLso); and the endogenous nucleic acid sequence encodes PAO1.

2. The method of claim 1, wherein expression of the polypeptide is decreased by contacting the plant with siRNA that targets the endogenous nucleic acid sequence.

3. The method of claim 1, wherein expression of the polypeptide is decreased by viral vector-mediated gene silencing.

4. The method of claim 1, wherein expression of the polypeptide is decreased by knocking out expression of the endogenous nucleic acid sequence.

5. The method of claim 1, wherein expression of the polynucleotide is reduced by editing the endogenous nucleic acid sequence to decrease or knockout its expression.

6. The method of claim 5, wherein the editing is CRISPR/CAS gene editing.

7. A plant provided by the method of claim 1.

8. A method of providing a plant with enhanced resistance to a disease, which comprises decreasing expression of a polypeptide encoded by an endogenous nucleic acid sequence in the plant, wherein:

the plant is citrus;

the disease is caused by *Candidatus Liberibacter asiaticus* (CLas);

the endogenous nucleic acid sequence encodes PAO1; and the expression of the polypeptide is decreased by gene editing, by viral vector-mediated gene silencing, by contacting the plant with siRNA that silences expression of the endogenous nucleic acid sequence, by knocking out expression of the endogenous nucleic acid sequence, or by CRISPR/CAS gene editing.

9. A plant provided by the method of claim 8.

10. The method of claim 1, wherein PAO1 has a sequence identical to SEQ. ID NO. 87.

11. The method of claim 8, wherein PAO1 has a sequence identical to SEQ. ID NO. 84.

* * * * *